(12) United States Patent
Simon et al.

(10) Patent No.: US 10,017,804 B2
(45) Date of Patent: *Jul. 10, 2018

(54) EFFICIENT PRODUCTION OF STEVIOL GLYCOSIDES IN RECOMBINANT HOSTS

(71) Applicant: Evolva SA, Reinach (CH)

(72) Inventors: Ernesto Simon, Glostrup (DK); Iben Nordmark Anderson, Vedbaek (DK); Michael Dalgaard Mikkelsen, Vaerløse (DK); Jorgen Hansen, Frederiksberg (DK); Veronique Douchin, Copenhagen (DK)

(73) Assignee: EVOLVA SA, Reinach (CH)

( * ) Notice: Subject to any disclaimer, the term of this patent is extended or adjusted under 35 U.S.C. 154(b) by 0 days.

This patent is subject to a terminal disclaimer.

(21) Appl. No.: 14/764,898

(22) PCT Filed: Feb. 11, 2014

(86) PCT No.: PCT/EP2014/052675
§ 371 (c)(1),
(2) Date: Jul. 30, 2015

(87) PCT Pub. No.: WO2014/122328
PCT Pub. Date: Aug. 14, 2014

(65) Prior Publication Data
US 2015/0361476 A1    Dec. 17, 2015

Related U.S. Application Data

(60) Provisional application No. 61/763,308, filed on Feb. 11, 2013, provisional application No. 61/763,290, filed on Feb. 11, 2013.

(51) Int. Cl.
*C12P 19/56* (2006.01)
*C12N 9/02* (2006.01)
(Continued)

(52) U.S. Cl.
CPC .......... *C12P 19/56* (2013.01); *C07K 14/395* (2013.01); *C12N 9/0042* (2013.01);
(Continued)

(58) Field of Classification Search
None
See application file for complete search history.

(56) References Cited

U.S. PATENT DOCUMENTS

| | | |
|---|---|---|
| 4,590,160 A | 5/1986 | Nishihashi et al. |
| 5,204,253 A | 4/1993 | Sanford et al. |

(Continued)

FOREIGN PATENT DOCUMENTS

| | | |
|---|---|---|
| CN | 101720910 | 6/2010 |
| CN | 102216313 | 10/2011 |

(Continued)

OTHER PUBLICATIONS

Mahe et al. (Journal of Biological Chemistry: vol. 271, pp. 25167-25172, 1996).*

(Continued)

*Primary Examiner* — Richard G Hutson
(74) *Attorney, Agent, or Firm* — McDonnell Boehnen Hulbert & Berghoff LLP

(57) ABSTRACT

Recombinant microorganisms are disclosed that produce steviol glycosides and have altered expression of one or more endogenous transporter or transcription factor genes, or that overexpress one or more heterologous transporters, leading to increased excretion of steviol glycosides of interest.

24 Claims, 24 Drawing Sheets

(51) Int. Cl.
*C07K 14/395* (2006.01)
*C12N 9/10* (2006.01)
*C12P 15/00* (2006.01)
*C12N 9/88* (2006.01)
*C12N 9/90* (2006.01)

(52) U.S. Cl.
CPC ......... *C12N 9/0073* (2013.01); *C12N 9/1048* (2013.01); *C12N 9/1051* (2013.01); *C12N 9/1062* (2013.01); *C12N 9/1085* (2013.01); *C12N 9/88* (2013.01); *C12N 9/90* (2013.01); *C12P 15/00* (2013.01); *C12Y 106/02004* (2013.01); *C12Y 114/13078* (2013.01); *C12Y 204/00* (2013.01); *C12Y 204/01013* (2013.01); *C12Y 204/01035* (2013.01); *C12Y 205/01029* (2013.01); *C12Y 402/03* (2013.01); *C12Y 402/03019* (2013.01); *C12Y 505/01013* (2013.01)

(56) References Cited

U.S. PATENT DOCUMENTS

| | | | |
|---|---|---|---|
| 5,306,862 | A | 4/1994 | Chappell et al. |
| 5,460,949 | A | 10/1995 | Saunders et al. |
| 5,538,880 | A | 7/1996 | Lundquist et al. |
| 6,013,863 | A | 1/2000 | Lundquist et al. |
| 6,215,051 | B1 | 4/2001 | Yu et al. |
| 6,255,557 | B1 | 7/2001 | Brandle |
| 6,284,493 | B1 | 9/2001 | Roth |
| 6,284,506 | B1 | 9/2001 | Hoshino et al. |
| 6,329,571 | B1 | 12/2001 | Hiei |
| 6,586,202 | B2 | 7/2003 | Hoshino et al. |
| 6,660,507 | B2 | 12/2003 | Cheng et al. |
| 6,806,076 | B1 | 10/2004 | Miyake et al. |
| 6,969,595 | B2 | 11/2005 | Brzostowicz et al. |
| 7,034,140 | B2 | 4/2006 | Bramucci et al. |
| 7,056,717 | B2 | 6/2006 | Cheng et al. |
| 7,098,000 | B2 | 8/2006 | Cheng et al. |
| 7,129,392 | B2 | 10/2006 | Hahn et al. |
| 7,132,268 | B2 | 11/2006 | Miyake et al. |
| 7,172,886 | B2 | 2/2007 | Keasling et al. |
| 7,183,089 | B2 | 2/2007 | Keasling et al. |
| 7,186,891 | B1 | 3/2007 | Chappell et al. |
| 7,208,298 | B2 | 4/2007 | Miyake et al. |
| 7,335,815 | B2 | 2/2008 | Boronat et al. |
| 7,364,885 | B2 | 4/2008 | Miyake et al. |
| 7,422,884 | B2 | 9/2008 | Bai et al. |
| 7,569,389 | B2 | 9/2009 | Feldmann et al. |
| 7,838,287 | B2 | 11/2010 | Goldsmith et al. |
| 7,923,541 | B2 | 4/2011 | Yang et al. |
| 7,927,851 | B2 | 4/2011 | Brandle et al. |
| 9,562,251 | B2 | 2/2017 | Kishore et al. |
| 2002/0142408 | A1 | 10/2002 | DiCosimo et al. |
| 2003/0033626 | A1 | 2/2003 | Hahn et al. |
| 2003/0148416 | A1 | 8/2003 | Berry et al. |
| 2003/0148479 | A1 | 8/2003 | Keasling et al. |
| 2003/0190734 | A1 | 10/2003 | Hoshino et al. |
| 2003/0219798 | A1 | 11/2003 | Gokarn et al. |
| 2004/0010815 | A1 | 1/2004 | Lange et al. |
| 2004/0072311 | A1 | 4/2004 | DiCosimo et al. |
| 2004/0078846 | A1 | 4/2004 | Desouza et al. |
| 2004/0176570 | A1 | 9/2004 | Bacher et al. |
| 2004/0194162 | A1 | 9/2004 | Hahn et al. |
| 2005/0003474 | A1 | 1/2005 | Desouza |
| 2005/0032169 | A1 | 2/2005 | Miyake et al. |
| 2006/0014264 | A1 | 1/2006 | Sauer |
| 2006/0079476 | A1 | 4/2006 | Keasling et al. |
| 2006/0083838 | A1 | 4/2006 | Jackson et al. |
| 2007/0004000 | A1 | 1/2007 | Miyake et al. |
| 2007/0077616 | A1 | 4/2007 | Keasling et al. |
| 2007/0099261 | A1 | 5/2007 | Keasling et al. |
| 2007/0128311 | A1 | 6/2007 | Prakash et al. |
| 2007/0166782 | A1 | 7/2007 | Keasling et al. |
| 2007/0202579 | A1 | 8/2007 | Berry et al. |
| 2007/0238157 | A1 | 10/2007 | Millis et al. |
| 2007/0238159 | A1 | 10/2007 | Millis et al. |
| 2007/0238160 | A1 | 10/2007 | Millis et al. |
| 2007/0254354 | A1 | 11/2007 | Millis et al. |
| 2007/0269857 | A1 | 11/2007 | Miyake et al. |
| 2007/0286850 | A1 | 12/2007 | Bai et al. |
| 2008/0064063 | A1 | 3/2008 | Brandle |
| 2008/0081358 | A1 | 4/2008 | Vittanen et al. |
| 2008/0131926 | A1 | 6/2008 | Miyake et al. |
| 2008/0261280 | A1 | 10/2008 | Hahn et al. |
| 2008/0271205 | A1 | 10/2008 | Yamaguchi et al. |
| 2008/0286870 | A1 | 11/2008 | Vittanen et al. |
| 2008/0292775 | A1 | 11/2008 | Prakash et al. |
| 2008/0318227 | A1 | 12/2008 | Bacher et al. |
| 2009/0004724 | A1 | 1/2009 | Keasling et al. |
| 2009/0047718 | A1 | 2/2009 | Blaschek et al. |
| 2009/0074935 | A1 | 3/2009 | Lee |
| 2009/0286262 | A1 | 11/2009 | Slack |
| 2010/0112156 | A1 | 5/2010 | Abelyan et al. |
| 2010/0221801 | A1* | 9/2010 | Van Dyk ............... C12P 7/16 435/160 |
| 2010/0297722 | A1 | 11/2010 | Anterola et al. |
| 2011/0087011 | A1 | 4/2011 | Chiang et al. |
| 2011/0092684 | A1 | 4/2011 | Varuzhan et al. |
| 2011/0160311 | A1 | 6/2011 | Prakash et al. |
| 2012/0021111 | A1 | 1/2012 | Pfister et al. |
| 2012/0083593 | A1 | 4/2012 | Liu et al. |
| 2012/0164678 | A1 | 6/2012 | Stephanopoulos et al. |
| 2012/0178169 | A1 | 7/2012 | Voytas et al. |
| 2013/0137138 | A1 | 5/2013 | Hansen |
| 2014/0329281 | A1 | 11/2014 | Houghton-Larsen et al. |
| 2015/0159188 | A1 | 6/2015 | Ono et al. |
| 2015/0342234 | A1 | 12/2015 | Hicks et al. |

FOREIGN PATENT DOCUMENTS

| | | |
|---|---|---|
| CN | 103397064 | 11/2013 |
| CN | 104845990 | 8/2015 |
| EP | 0955363 | 11/1999 |
| EP | 1072683 | 1/2001 |
| EP | 1171610 | 4/2007 |
| EP | 1198575 | 9/2007 |
| EP | 1383864 | 1/2008 |
| EP | 1897951 | 3/2008 |
| EP | 1947189 | 7/2008 |
| EP | 1392824 | 8/2008 |
| EP | 2902410 | 8/2015 |
| JP | 59101408 | 6/1984 |
| JP | 3-277275 | 12/1991 |
| JP | 05-115298 | 5/1993 |
| JP | 2009034080 | 2/2009 |
| KR | 20150000258 | 1/2015 |
| WO | WO 1999/018224 | 4/1999 |
| WO | WO 2000/036081 | 6/2000 |
| WO | WO 2000/037663 | 6/2000 |
| WO | WO 2000/063400 | 10/2000 |
| WO | WO 2001/012828 | 2/2001 |
| WO | WO 2001/083769 | 11/2001 |
| WO | WO 2001/094561 | 12/2001 |
| WO | 2002/024865 | 3/2002 |
| WO | WO 2002/020728 | 3/2002 |
| WO | WO 2002/020815 | 3/2002 |
| WO | WO 2002/055709 | 7/2002 |
| WO | WO 2003/008540 | 1/2003 |
| WO | WO 2004/029255 | 4/2004 |
| WO | WO 2005/079183 | 9/2005 |
| WO | WO 2006/016395 | 2/2006 |
| WO | WO 2006/093289 | 9/2006 |
| WO | WO 2006/096392 | 9/2006 |
| WO | WO 2007/136847 | 11/2007 |
| WO | WO 2008/008256 | 1/2008 |
| WO | WO 2008/034648 | 3/2008 |
| WO | WO 2008/039499 | 4/2008 |
| WO | WO 2008/051349 | 5/2008 |
| WO | WO 2009/005704 | 1/2009 |
| WO | WO 2009/071277 | 6/2009 |
| WO | WO 2009/086049 | 7/2009 |
| WO | WO 2009/105612 | 8/2009 |
| WO | WO 2009/108680 | 9/2009 |

(56) References Cited

FOREIGN PATENT DOCUMENTS

| | | |
|---|---|---|
| WO | 2009/140394 | 11/2009 |
| WO | WO 2009/140394 | 11/2009 |
| WO | WO 2010/021001 | 2/2010 |
| WO | WO 2010/038911 | 4/2010 |
| WO | WO 2010/142305 | 12/2010 |
| WO | WO 2010/146463 | 12/2010 |
| WO | WO 2011/028671 | 3/2011 |
| WO | WO 2011/037959 | 3/2011 |
| WO | WO 2011/046423 | 4/2011 |
| WO | WO 2011/056834 | 5/2011 |
| WO | WO 2011/153378 | 8/2011 |
| WO | WO2011/140329 | 11/2011 |
| WO | 2011/151326 | 12/2011 |
| WO | 2011/153378 | 12/2011 |
| WO | WO 2011/151326 | 12/2011 |
| WO | WO 2011/153144 | 12/2011 |
| WO | WO 2012/075030 | 6/2012 |
| WO | 2013/022989 | 2/2013 |
| WO | WO 2013/019050 | 2/2013 |
| WO | WO 2013/022989 | 2/2013 |
| WO | WO 2013/076577 | 5/2013 |
| WO | WO 2013/096420 | 6/2013 |
| WO | WO 2013/102793 | 7/2013 |
| WO | WO 2013/110673 | 8/2013 |
| WO | WO 2013/176738 | 11/2013 |
| WO | WO 2014/086890 | 6/2014 |
| WO | WO 2014/122227 | 8/2014 |
| WO | WO2014/191580 | 12/2014 |
| WO | WO 2014/191581 | 12/2014 |
| WO | WO 2015/007748 | 1/2015 |
| WO | WO 2015/011209 | 1/2015 |
| WO | WO 2015/014959 | 2/2015 |
| WO | WO 2015/014969 | 2/2015 |
| WO | WO 2015/016393 | 2/2015 |
| WO | WO 2015/028324 | 3/2015 |
| WO | WO 2015/132411 | 9/2015 |
| WO | WO 2016/023844 | 2/2016 |
| WO | WO 2017025362 | 2/2016 |
| WO | WO 2016/038095 | 3/2016 |
| WO | WO 2016/120486 | 8/2016 |

OTHER PUBLICATIONS

Jewett et al. "An integrated cell-free metabolic platform for protein production and synthetic biology," Mol Syst Biol. 4:220 (2008).
Johnstone et al., "Cloning an Aspergillus nidulans developmental gene by transformation," EMBO J. 4(5):1307-11 (1985).
Khoury et al., "Computational design of Candida boidinii xylose reductase for altered cofactor specificity," Protein Sci. 18(10):2125-38 (Oct. 2009).
Kim et al., "Hydroxylation of ent-Kaurenoic Acid to Steviol in Stevia rebaudiana Bertoni-Purification and Partial Characterization of the Enzyme," Arch Biochem Biophys. 332(2):223-30 (1996).
Kim & Shibata, "Characterization of ent-kaurenoic acid 13-hydroxylase in steviol biosynthesis of Stevia rebaudiana Bertoni," Journal of the Korean Agriculturalchemical Society 40(6):501-7 (1997).
Knowles et al., "Genetic Transformation and Plant Regeneration in Stevia rebaudiana Using Microprojectile Bombardment," In Vitro Cellular & Developmental Biology 39(abstract):23-A (2003).
Kohda et al., "New Sweet Diterpene glucoside from Stevia Rebaudiana," Phytochemistry 15(6):981-3 (1976).
Kondo et al., "Preparation of high activity whole cell biocatalyst by permeabilization of recombinant flocculent yeast with alcohol," Enzyme Microb Technol. 27(10),806-11 (2000).
"Kumar et al., ""A comprehensive analysis of fifteen genes of steviol glycosides biosynthesis pathwayin Stevia rebaudiana (Bertoni)"" Gene 492:276-84 (Epub Oct. 20, 2011)."
Kusama et al., "Transglucosylation into stevioside by the enzyme system from *Streptomyces* sp.," Agric. Biol. Chem. 50(10):2445-51 (Oct. 1986).

Li et al., "Crystal structure of Medicago truncatula UGT85H2—insights into the structural basis of a multifunctional (iso) flavonoid glycosyltransferase," J Mol Biol. 370(5):951-63 (2007).
Li et al., "Systematic Mutational Analysis of Peptide Inhibition of the p53-MDM2/MDMX," J Mol Biol. 398(2):200-13 (2010).
Li et al., "High-density cultivation of oleaginous yeast Rhodosporidium toruloides Y4 in fed-batch culture," Enzyme and Microbial Technology 41(3):312-7 (Aug. 2007).
Liu et al., "Preparation of high-activity whole cell biocatalysts by permeabilization of recombinant yeasts with alcohol," J Biosci Bioeng. 89(6):554-8 (2000).
Ma et al., "Molecular cloning and characterization of Stevia Rebaudiana UDP-glucosyltransferase," Acta Biologiae Experimentalis Sinica 36(2):123-9 (2003).
Ma "Part 1. Molecular Cloning and Functional Analysis of UDPG Glucosyltransferase Gene. Part 2. Molecular Cloning, Sequence Analysis and Evolution of Actin and EF1a Genes in Stevia Rebaudiana." Chinese Doctor and Master Dissertations Full-Text Database, Agricultural Technology Part, vol. 2; pp. 1-74 (2004).
Madan et al., "Stevia rebaudiana (Bert.) Bertoni—A Review," Indian Journal of Natural Products and Resources 1 (3):267-86 (2010).
Madhav et al., "Functional and structural variation of uridine diphosphate glycosyltransferase (UGT) gene of Stevia rebaudiana—UGTSr involved in the synthesis of rebaudioside A," Plant Physiol. Biochem. 63:245-53 (Feb. 2013).
Malonek et al., "The NADPH-cytochrome P450 Reductase Gene from Gibberalla fujikuroi is Essential for Gibberellin Biosynthesis," J Rio Chem. 279(24):25075-84 (2004).
Mantovaneli et al., "The effect of temperature and flow rate on the clarification of the aqueous stevia-extract in fixed-bed column with zeolites," Braz J Chem Eng. 21(3):449-58 (2004).
Mattanovich et al., "Recombinant protein production in yeasts," Methods Mol Biol. 824:329-58 (2012).
Megeji et al., "Introducing Stevia rebaudiana, a natural zero-calorie sweetener," Current Science 88(5):801-4 (2005).
Mohamed et al., "UDP-dependent glycosyltransferases involved in the biosynthesis of steviol glycosides" Journal of Plant Physiology 168(10):1136-1141 (Jul. 2011; Epub Apr. 7, 2011).
Mumberg et al., "Yeast vectors for the controlled expression of heterologous proteins in different genetic backgrounds," Gene 156(1):119-22 (1995).
Naesby et al., "Yeast artificial chromosomes employed for random assembly of biosynthetic pathways and production of diverse compounds in *Saccharomyces cerevisiae*," Microb Cell Fact. 8:45 (2009).
Naglak & Wang, "Rapid protein release from *Escherichia coli* by chemical permeabilization under fermentation conditions," Biotechnol Bioeng. 39(7):732-40 (1991).
Nakagiri et al., "cDNA cloning, functional expression and characterization of ent-copalyl diphosphate synthase from *Scoparia dulcis* L.," Plant Sci. 169:760-7 (2005).
Nelson et al., "P450 superfamily: update on new sequences, gene mapping, accession Numbers and nomenclature," Pharmacogenetics 6:1-42 (1996).
Newman et al., "High-level production of amorpha-4,11-diene in a two-phase partitioning bioreactor of metabolically engineered *Escherichia coli*," Biotechnol Bioeng 95(4):684-91 (2006).
Nicaud, "Yarrowia lipolytica," Yeast 29(10):409-18 (Oct. 2012).
Nielsen et al., "Efficient PCR-based gene targeting with a recyclable marker for Aspergillus nidulans," Fungal Genet Biol. 43(1):54-64 (2006).
Nour-Eldin et al., "USER cloning and USER fusion: the ideal cloning techniques for small and big laboratories," Methods Mol Biol. 643:185-200 (2010).
Ohta et al., "Characterization of Novel Steviol Glycosides from Leaves of Stevia rebaudiana Morita," J. Applied Glycosides 57(3):199-209 (Mar. 2010).
Ohta et al., MassBank Accession No. FU000341 (May 2011).
Ohta et al., MassBank Accession No. FU000342 (May 2011).
Ohta et al., MassBank Accession No. FU000343 (May 2011).

(56) References Cited

OTHER PUBLICATIONS

Ohtani et al., "Further Study on the 1,4-alpha-Transglucosylation of Rubusoside, a Sweet Steviol-Bisglucoside from Rubus suavissimus," Agric Biol Chem. 55(2):449-53 (1991).
Oka & Jigami, "Reconstruction of de novo pathway for synthesis of UDP-glucuronic acid and UDP-xylose from intrinsic UDP-glucose in *Saccharomyces cerevisiae*," FEBS J. 273(12):2645-57 (2006).
Orihara et al., "Biotransformation of steviol by cultured cells of eucalyptus perriniana and Coffea Arabica," Phytochemistry 30(12):3989-92 (1991).
Paradise et al., "Redirection of flux through the FPP branch-point in *Saccharomyces cerevisiae* by down-regulating squalene synthase," Biotechnol Bioeng. 100(2):371-8 (2008).
Pearson & Lipman, "Improved tools for biological sequence comparison," Proc Natl Acad Sci. 85(8)2444-8 (1998).
Piirainen et al., "Glycoengineering of yeasts from the perspective of glycosylation efficiency," N Biotechnol. 31 (6):532-7 (Dec. 2014).
Pompon et al., "Yeast Expression of Animal and Plant P450s in Optimized RedoxEnvironments," Methods Enzymol 272:51-64 (1996).
Prelich, "Gene overexpression: uses, mechanisms, and interpretation," Genetics 190(3):841-54 (Mar. 2012).
Presecki & Vasic-Racki, "Production of L-malic acid by permeabilized cells of commercial *Saccharomyces* sp. strains," Biotechnol Lett. 27(23-24):1835-9 (2005).
Ro et al., "Production of the antimalarial drug precursor artemisinic acid in engineered yeast," Nature 440(7086):940-3 (2006).
Saenge et al., "Potential use of oleaginous red yeast Rhodotorula glutinis for the bioconversion of crude glycerol from biodiesel plant to lipids and carotenoids," Process Biochemistry 46(1):210-8 (Jan. 2011).
Schwab et al., Poster, "Watchmaker®—Compound Generation by Combinatorial Genetics and Screening in Yeast," 141st Annual Conference in St. Louis, 2008, 1 page.
Sen et al., "Developments in Directed Evolution for Improving Enzyme Functions," Appl Biochem Biotechnol.143 (3):212-23 (2007).
Senthilraja et al., "RNA secondary structure prediction: Analysis of *Saccharomyces cerevisiae* RNAs," Int. J. Pharm. Rev. Res. 25(2):287-91 (Mar.-Apr. 2014).
Abraham & Bhat, "Permeabilization of baker's yeast with N-lauroyl sarcosine," J Ind Microbial Biotechnol. 35 (8):799-804 (2008).
Ageitos et al., "Oily yeasts as oleaginous cell factories," Appl Microbiol Biotechnol. 90(4):1219-27 (May 2011).
Agrawal, "NMR spectroscopy in the structural elucidation of oligosaccharides and glycosides," Phytochemistry 31 (10):3307-30 (1992).
Ajikumar et al., "Terpenoids: opportunities for biosynthesis of natural product drugs using engineered microorganisms," Molecular Pharmaceuticals 5(2):167-90 (2008).
Alakomi et al., "Lactic acid permeabilizes gram-negative bacteria by disrupting the outer membrane," Appl Environ Microbiol. 66(5):2001-5 (2000).
Ali et al., "Biochemical investigation during different stages of in vitro propagation of Stevia rebaudiana," Pak J Bot. 42(4):2827-37 (2010).
Bankar et al., "Environmental and industrial applications of Yarrowia lipolytica," Appl Microbiol Biotechnol. 84 (5):847-65 (Oct. 2009).
Baykov et al., "A malachite green procedure for orthophosphate determination and its use in alkaline phosphatase-based enzyme immunoassay," Anal Biochem. 171(2):266-70 (Jun. 1988).
Beopoulos et al., "Yarrowia lipolytica: A model and a tool to understand the mechanisms implicated in lipid accumulation," Biochimie 91(6):692-6 (Jun. 2009).
Brandle et al., "Leaf ESTs from Stevia rebaudiana: A Resource for Gene Discovery in Diterpene Synthesis," Plant Mol Biol. 50(4-5):613-22 (2002).
Brandle & Telmer, "Steviol glycoside biosynthesis," Phytochemistry 68(14):1855-63 (2007).

Brochado et al. "Improved vanillin production in baker's yeast through in silico design," Microb Cell Fact. 9:84-98 (2010).
Carretero-Paulet et al., "Expression and Molecular Analysis of the Arabidopsis DXR Gene Encoding 1-Deoxy-d-Xylulose 5-Phosphate Reductoisomerase, the First Committed Enzyme of the 2-C-Methyl-D-Erythritol 4-Phosphate Pathway," Plant Physiol. 129(4):1581-91 (2002).
Ceunen & Geuns, "Steviol glycosides: chemical diversity, metabolism, and function," J. Nat. Prod. 76(6):1201-28 (Jun. 2013).
Chemler et al., "Biosynthesis of isoprenoids, polyunsaturated fatty acids and flavonoids in *Saccharomyces cerevisiae*," Microb Cell Fact. 5:20 (2006).
Chen et al., "MolProbity: all-atom structure validation for macromolecular crystallography," Acta Crystallogr D Biol Crystallogr 66(Pt 1):12-21 (Jan. 2010).
Chica et al., "Semi-rational approaches to engineering enzyme activity: combining the benefits of directed evolution and rational design," Curr Opin Biotechnol.16(4):378-84 (2005).
Chow & Palecek, "Enzyme encapsulation in permeabilized *Saccharomyces cerevisiae* cells," Biotechnol Prog. 20 (2):449-56 (2004).
Correa et al., "Genetic mapping of 1,3-beta-glucanase-encoding genes in *Saccharomyces cerevisiae*," Current Genet. 22(4):283-8 (1992).
Darise et al., "Enzymic Transglucosylation of Rubusoside and the Structure-Sweetness Relationship of Steviol-Bisglycosides," Agric. Biol. Chem. 48(10):2483-8 (Jan. 1984).
Davis et al., "MolProbity: all-atom contacts and structure validation for proteins and nucleic acids," Nucleic Acids Res. 35:W375-83 (Apr. 2007).
Del Sorbo et al., "Fungal transporters involved in efflux of natural toxic compounds and fungicides," Fungal. Genet. Biol. 30(1):1-15 (Jun. 2000).
Diener et al., "Arabidopsis ALF5, a multidrug efflux transporter gene family member, confers resistance to toxins," Plant Cell 13(7):1625-38 (Jul. 2001).
Dodhia et al., "Engineering human cytochrome P450 enzymes into catalytically self-sufficient chimeras using molecular Lego," J Biol Inorg Chem. 11(7):903-16 (Oct. 2006).
Dubey, et al., An overview of the non-mevalonate pathway for terpenoid biosynthesis in plants, J. Biosci. 28 (5):637-46 (2003).
Dubois & Stephenson, "Diterpenoid sweeteners. Synthesis and sensory evaluation of stevioside analogues with improved organoleptic properties," J. Med. Chem. 28(1):93-8 (Jan. 1985).
EFSA Panel on Food Additives and Nutrient Sources added to Food (ANS), "Scientific Opinion on the safety of steviol glycosides for the proposed uses as a food additive," EFSA Journal 8(4):1537 (2010).
Eisenreich et al., "Biosynthesis of isoprenoids via the non-mevalonate pathway," Cell Mol Life Sci. 61(12):1401-6 (2004).
EMBOSS Needle results for Pairwise Sequence Alignment of UGT91D1 and UGT91D2; dated Apr. 4, 2016, 2 pages.
Emmerstorfer et al., "Over-expression of ICE2 stabilizes cytochrome P450 reductase in *Saccharomyces cerevisiae* and Pichia pastoris," Biotechnol J. 10(4):623-35 (Apr. 2015).
Estrada De Martin et al., "Ice2p is important for the distribution and structure of the cortical ER network in *Saccharomyces cerevisiae*," J Cell Sci. 118(Pt 1):65-77 (Oct. 2006).
Fernandez et al., "Activation of chitin synthetase in permeabilized cells of a *Saccharomyces cerevisiae* mutant lacking proteinase B," J Bacteriol. 152(3):1255-64 (1982).
Flores et al., "Permeabilization of yeast cells (Kluyveromyces lactis) with organic solvents," Enzyme Microb Technol. 16(4):340-6 (1994).
Fowler & Zabin, "Effects of Dimethylsulfoxide on the Lactose Operon in *Escherichia coli*," J Bacterial. 92(2):353-7 (1966).
Freire, "Differential scanning calorimetry," Methods Mol Biol. 40:191-218 (1995).
Fukunaga et al., "Enzymatic transglucosylation products of stevioside: separation and sweetness-evaluation," Agric. Biol. Chem. 53(6):1603-7 (Jan. 1989).
Geuns, "Stevioside," Phytochemistry 64(5):913-21 (2003).

(56) References Cited

OTHER PUBLICATIONS

Giaever & Nislow, "The yeast deletion collection: a decade of functional genomics," Genetics 197(2):451-65 (Jun. 2014).
Gietz & Schiestl, "High-efficiency yeast transformation using the LiAc/SS carrier DNA/PEG method," Nat Protoc. 2(1):31-4 (2007).
Girvan et al., "Flavocytochrome P450 BM3 mutant W1046A is a NADH-dependent fatty acid hydroxylase: implications for the mechanism of electron transfer in the P450 BM3 dimer," Arch Biochem Biophys. 507(1):75-85 (Mar. 2011).
Goralczyk, "Compounds from Stevia for Improving and Maintaining Mental Performance," Stevia World Forum, Feb. 24-25, 2010, 17 pages.
Guleria & Yadav, "Insights into Steviol Glycoside Biosynthesis Pathway Enzymes Through Structural Homology Modeling," Am. J. Biochem. Molec. Biol. 3(1):1-19 (2013).
Gunel et al., "Metabolic Engineering for Production of Geranylgeranyl Pyrophosphate Synthase in Non-Carotenogenic Yeast *Schizosaccharomyces Pombe*," Biotechnol. & Biotechnol. Eq. 20(3):76-82 (2006).
Hansen et al., "De novo biosynthesis of vanillin in fission yeast (*Schizosaccharomyces pombe*) and baker's yeast (*Saccharomyces cerevisiae*)," Appl Environ Microbial. 75(9):2765-74 (2009).
Hansen et al., "Versatile Enzyme Expression and Characterization System for Aspergillus nidulans, with the Penicillium brevicompactum Polyketide Synthase Gene from the Mycophenolic Acid Gene Cluster as a Test Case," Appl Environ Microbiol. 77(9):3044-51 (2011).
Hellfritsch et al., "Human psychometric and taste receptor responses to steviol glycosides," J. Agric. Food Chem. 60(27):6782-93 (Jul. 2012).
Humphrey et al., "Spatial organisation of four enzymes from Stevia rebaudiana that are involved in steviol glycoside synthesis," Plant Mol Bio. 61(1-2):47-62 (2006).
Iandolino et al., "High-Quality RNA, cDNA, and Derived EST Libraries From Grapevine (*Vitis vinifera* L.)," Plant Mol Biol Reporter 22:269-78 (2004).
Irmler et al., "Indole alkaloid biosynthesis in Catharanthus roseus: new enzyme activities and identification of cytochrome P450 CYP72A1 as secologanin synthase," Plant J. 24(6):797-804 (2000).
Jennewein et al., "Taxol biosynthesis: baxane 13 alpha-hydroxylase is a cytochrome P450-dependent monooxygenase," Proc Natl Acad Sci U S A 98(24):13595-600 (2001).
International Search Report issued by the International Searching Authority for International Application No. PCT/US2011/038967, dated Sep. 1, 2011 (10 pages).
Written Opinion of the International Searching Authority for International Application No. PCT/US2011/038967, dated Sep. 1, 2011 (12 pages).
International Preliminary Report on Patentability issued by the International Bureau for International Application No. PCT/US2011/038967, dated Dec. 4, 2012 (13 pages).
Third-Party Submission under 37 CFR 1.290 for U.S. Appl. No. 13/701,406, dated Mar. 22, 2013 (238 pages).
Extended European Search Report and Opinion issued by the European Patent Office for European Application No. 11790428.4, dated Dec. 20, 2013.
Search Report issued by the Intellectual Property Office of Singapore for Singaporean Application No. 201208854-8, dated Nov. 3, 2014.
Non-Final Office Action for U.S. Appl. No. 14/237,540, dated Dec. 30, 2015 (pp. 1-19).
Final Office Action issued in U.S. Appl. No. 14/237,540; dated Jul. 8, 2016, pp. 1-19.
International Search Report issued by the International Searching Authority for International Application No. PCT/US2012/050021, dated Apr. 12, 2013.
Written Opinion of the International Searching Authority for International Application No. PCT/US2012/050021, dated Apr. 12, 2013.

International Preliminary Report on Patentability issued by the International Bureau for International Application No. PCT/US2012/050021, dated Feb. 11, 2014.
Extended European Search Report issued in EP 15193074.0; dated Feb. 12, 2016, pp. 1-9.
International Search Report from the International Searching Authority for International Application No. PCT/EP2014/052363, dated Sep. 22, 2014 (12 pages).
Written Opinion of the International Searching Authority for International Application No. PCT/EP2014/052363, dated Sep. 22, 2014 (10 pages).
International Preliminary Report on Patentability issued by the International Bureau for International Application No. PCT/EP2014/052363, dated Aug. 11, 2015. (11 pages).
International Preliminary Report on Patentability issued by the International Bureau for International Application No. PCT/EP2014/052675, dated Aug. 11, 2015 (8 pages).
International Search Report of the International Searching Authority for International Application No. PCT/EP2013/075587, dated Feb. 20, 2014 (pp. 1-5).
Written Opinion of the International Searching Authority for International Application No. PCT/EP2013/075587, dated Feb. 20, 2014 (pp. 1-9).
International Preliminary Report on Patentability from the International Bureau for International Application No. PCT/EP2013/075587, dated Jun. 9, 2015 (pp. 1-10).
Third Party Submission in U.S. Appl. No. 14/648,747; dated Mar. 28, 2016, pp. 1-231.
Invitation to Pay Additional Fees and, Where Applicable, Protest Fee by the International Searching Authority for International Application No. PCT/EP2015/070620, dated Nov. 27, 2015 (pp. 1-14).
International Search Report by the International Searching Authority for International Application No. PCT/EP2015/070620; dated Mar. 29, 2016, pp. 1-10.
Written Opinion of the International Searching Authority for International Application No. PCT/EP2015/070620; dated Mar. 29, 2016, pp. 1-24.
International Search Report and Written Opinion of the International Searching Authority for International Application No. PCT/EP2015/068314, dated Jan. 20, 2016 (pp. 1-7).
Written Opinion of the International Searching Authority for International Application No. PCT/EP2015/068314, dated Jan. 20, 2016 (pp. 1-9).
International Search Report and Written Opinion of the International Searching Authority for International Application No. PCT/EP2015/052007; dated Jul. 4, 2016, pp. 1-24.
Shao et al., "Crystal structures of a multifunctional triterpene/flavonoid glycosyltransferase from Medicago truncatula," Plant Cell 17(11):3141-54 (2005).
Shibata et al., "Glucosylation of Steviol and Steviol-Glucosides in Extracts from Stevia rebaudiana Bertoni" Plant Physiol. 95(1):152-56 (1991).
Singh et al., "Compendium of Transgenic Crop Plants: Transgenic Sugar, Tuber and Fiber," Ed. Kole & Hall, Blackwell Publishing Ltd. pp. 97-115 (2008).
U.S. Food and Drug Administration GRAS Notice 323, "GRAS Assessment of High Purity Steviol Glycosides; Food Usage Conditions for General Recognition of Safety for PureCircle USA, Inc.," pp. 1-262 (Feb. 2010).
U.S Food and Drug Administration GRAS Notice Notice 329, "Notice to the U.S. Food and Drug Administration that the use of RebpureTM (Rebaudioside A) derived from Stevia rebaudiana, as a Food Ingredient is Generally Recognized as Safe (GRAS)," pp. 1-275 (Mar. 2010).
Van Ooyen et al., "Heterologous protein production in the yeast Kluyveromyces lactis," FEMS Yeast Res. 6 (3):381-92 (May 2006).
Vazquez De Aldana et al., "Nucleotide sequence of the exo-1,3-beta-glucanase-encoding gene, EXG1, of the yeast *Saccharomyces cerevisiae*," Gene 97(2):173-82 (1991).
Verwaal et al., "High-Level Production of Beta-Carotene in *Saccharomyces cerevisiae* by Successive Transformation with

(56) References Cited

OTHER PUBLICATIONS

Carotenogenic Genes from Xanthophyllomyces dendrorhous," Appl Environ Microbiol. 73 (13):4342-50 (2007).
Wallin, "Steviol Glycosides," Chem. Tech Assessment—63rd JECFA, pp. 1-5 (2004).
Wallin, "Steviol Glycosides," Chem. Tech Assessment—69th JECFA, pp. 1-7 (2007).
Wallner & Elofsson, "Can correct protein models be identified?," Protein Sci. 12(5):1073-86 (May 2003).
Wang, "Structure, mechanism and engineering of plant natural product glycosyltransferases," FEBS Letters 583 (20):3303-9 (2009).
Xu et al., "Generation of hepatitis B virus PreS2-S antigen in Hansenula polymorpha," Viral Sin. 29(6):403-9 (Dec. 2014).
Yadav et al., "A review on the improvement of stevia [Stevia rebaudiana (Bertoni)]," Can J Plant Sci. 91:1-27 (2011).
Yao et al., "A genetic linkage map for Stevia rebaudiana," Genome 42:657-61 (1999).
Yazaki, "ABC transporters involved in the transport of plant secondary metabolites," FEBS Lett. 580(4):1183-91 (Feb. 2006).
Yu et al., "Bioconversion of ethyl 4-chloro-3-oxobutanoate by permeabilized fresh brewer's yeast cells in the presence of allyl bromide," J Ind Microbial Biotechnol. 34(2)151-6 (2007).
Yuan et al., "Kinetics and activation parameters for oxidations of styrene by Compounds I from the cytochrome P450 (BM-3) (CYP102A1) heme domain and from CYP119," Biochemistry 48(38):9140-6 (Sep. 2009).
Zheng et al. "An efficient one-step site-directed and site-saturation mutagenesis protocol," Nucleic Acids Res. 32(14): e115 (Aug. 2004).
Zhu et al., "A multi-omic map of the lipid-producing yeast Rhodosporidium toruloides," Nature Commun. 3:1112 (Oct. 2012).
GenBank Accession No. AAF61439.1, dated Sep. 25, 2000 (2 pages).
GenBank Accession No. AAM53963.1, dated Jun. 17, 2002 (2 pages).
GenBank Accession No. AAR06918.1, dated Dec. 28, 2004 (2 pages).
GenBank Accession No. AAT93110.1, dated Apr. 24, 2007 (2 pages).
GenBank Accession No. ACE87855.1, dated Jun. 24, 2008 (1 page).
GenBank Accession No. ACM47734.1, dated Feb. 7, 2009 (1 page).
GenBank Accession No. ACT33422.1, dated Jul. 17, 2009 (1 page).
GenBank Accession No. AF515727.1, dated Jun. 17, 2002 (2 pages).
GenBank Accession No. AY345974.1, dated Dec. 28, 2004 (2 pages).
GenBank Accession No. AY345978.1, dated Dec. 28, 2004 (2 pages).
Genbank Accession No. AY345980.1, dated Dec. 28, 2004 (2 pages).
GenBank Accession No. AY345982.1, dated Dec. 28, 2004 (2 pages).
GenBank Accession No. BG521726.1, dated May 13, 2000 (2 pages).
GenBank Accession No. CAA23011.1, dated Oct. 23, 2008 (2 pages).
GenBank Accession No. CAA46815.1, dated Apr. 18, 2005 (2 pages).
GenBank Accession No. DQ269454.4, dated May 28, 2008 (2 pages).
GenBank Accession No. EU722415.1, dated Jun. 10, 2008 (2 pages).
GenBank Accession No. EU751291.1, dated Jun. 24, 2008 (2 pages).
EBI Accession No. AAY05902, "Jerusalem artichoke in-chain hydroxylase CYP81B1" (1 page).
EBI Accession No. ABM86477, "Rice abiotic stress responsive polypeptide SEQ ID No. 4723" (1 page).
UniProt Accession No. F2DG34, May 2011 (pp. 1-4).
UniProt Accession No. Q6VAA8, 2004 (pp. 1-6).
UniProt Accession No. Q7FPQ4, 2004 (pp. 1-6).
Liu et al., "Functional and Biochemical Characterization of Escherichia coli Sugar Efflux Transporters," JBC, 274 (33)22977-22984 (Aug. 2009).
Sun et al., "Regulation and Function of Escherichia coli Sugar Efflux Transporter A (Set A) during Glucose-Phosphate Stress," J of Bacteriology, 193(1):143-153 (Jan. 2011).
International Search Report and Written Opinion of the International Searching Authority for International Application No. PCT/EP2016/068259; dated Jan. 24, 2017, pp. 1-18.
GenBank Accession No. XM_001467423, dated Jul. 16, 2015 (2 pages).
GenBank Accession No. XP_002282091, dated Dec. 7, 2011 (1 page).
GenBank Accession No. XP_002288339, dated Jul. 15, 2009 (2 pages).
GenBank Accession No. XP 002311286, dated Dec. 31, 2013 (2 pages).
GenBank Accession No. ZP_05004570, dated Jun. 8, 2010 (2 pages).
Gossen & Bujard, "Studying gene function in eukaryotes by conditional gene inactivation," Annu. Rev. Genet. 36:153-73 (Jun. 2002).
Gritz & Davies, "Plasmid-encoded hygromycin B resistance: the sequence of hygromycin B phosphotransferase gene and its expression in Escherichia coli and Saccharomyces cerevisiae," Gene 25(2-3):179-88 (Nov. 1983).
Hallstrom & Moye-Rowley, "Divergent transcriptional control of multidrug resistance genes in Saccharomyces cerevisiae," J. Biol. Chem. 273(4):2098-104 (Jan. 1998).
Katzmann et al., "Expression of an ATP-binding cassette transporter-encoding gene (YOR1) is required for oligomycin resistance in Saccharomyces cerevisiae," Mol. Cell Biol. 15(12):6875-83 (Dec. 1995).
Li et al., "Phylogenetic analysis of the UDP-glycosyltransferase multigene family of Arabidopsis thaliana," J. Biol. Chem. 276(6):4338-43 (Oct. 2000).
Masada et al., "An efficient chemoenzymatic production of small molecule glucosides with in situ UDP-glucose recycling," FEBS Lett. 581(13):2562-6 (May 2007).
Morita et al., "Japanese morning glory dusky mutants displaying reddish-brown or purplish-gray flowers are deficient in a novel glycosylation enzyme for anthocyanin biosynthesis, UDP-glucose:anthocyanidin 3-O-glucoside-2"-O-glucosyltransferase, due to 4-bp insertions in the gene," Plant J. 42(3):353-63 (May 2005).
Nagy et al., "Role of the yeast ABC transporter Yor1p in cadmium detoxification," Biochimie 88(11):1665-71 (Jun. 2006).
Nikaido & Takatsuk, "Mechanisms of RND multidrug efflux pumps," Biochim. Biophys. Acta. 1794(5):769-81 (May 2009).
Osmani et al., "Catalytic key amino acids and UDP-sugar donor specificity of a plant glucuronosyltransferase, UGT94B1: molecular modeling substantiated by site-specific mutagenesis and biochemical analyses," Plant Physiol. 148(3):1295-308 (Nov. 2008).
Osmani et al., "Substrate specificity of plant UDP-dependent glycosyltransferases predicted from crystal structures and homology modeling," Phytochemistry 70(3):325-47 (Feb. 2009).
Richman et al., "Functional genomics uncovers three glucosyltransferases involved in the synthesis of the major sweet glucosides of Stevia rebaudiana," Plant J. 41(1):56-67 (Jan. 2005).
Riesmeier et al., "Isolation and characterization of a sucrose carrier cDNA from spinach by functional expression in yeast," EMBO J. 11(13):4705-13 (Dec. 1992).
Rodríguez-Concepción & Boronat, "Elucidation of the methylerythritol phosphate pathway for isoprenoid biosynthesis in bacteria and plastids. A metabolic milestone achieved through genomics," Plant Physiol. 130 (3):1079-89 (Nov. 2002).
Saier Jr et al., "The major facilitator superfamily," J. Mol. Microbiol. Biotechnol. 1(2):257-79 (Nov. 1999).
Saier Jr et al., "The Transporter Classification Database: recent advances," Nucleic Acids Res. 37:D274-8 (Jan. 2009).

(56) References Cited

OTHER PUBLICATIONS

Sauer et al., "The soluble and membrane-bound transhydrogenases UdhA and PntAB have divergent functions in NADPH metabolism of *Escherichia coli*," J. Biol. Chem. 279(8):6613-9 (Dec. 2003).
Sawada et al., "UDP-glucuronic acid:anthocyanin glucuronosyltransferase from red daisy (*Bellis perennis*) flowers. Enzymology and phylogenetics of a novel glucuronosyltransferase involved in flower pigment biosynthesis," J. Biol. Chem. 280(2):899-906 (Jan. 2005).
Shao et al., "Enhanced production of alpha-galactosyl epitopes by metabolically engineered Pichia pastoris," Appl. Environ. Microbiol. 69(9):5238-42 (Sep. 2003).
Son et al., "Production of flavonoid O-glucoside using sucrose synthase and flavonoid O-glucosyltransferase fusion protein," J. Microbiol. Biotechnol. 19(7):709-12 (Jul. 2009).
Sonnhammer et al., "Pfam: a comprehensive database of protein domain families based on seed alignments," Proteins 28(3):405-20 (Jul. 1997).
Sonnhammer et al., "Pfam: multiple sequence alignments and HMM-profiles of protein domains," Nucleic Acids Res. 26(1):320-2 (Jan. 1998).
International Search Report by the International Searching Authority for International Application No. PCT/EP2014/052675, dated Apr. 23, 2014 (5 pages).
Written Opinion of the International Searching Authority for International Application No. PCT/EP2014/052675, dated Apr. 23, 2014 (7 pages).
Communication pursuant to Rules 161(1) and 162 EPC for European Application No. 14704558.7, dated Sep. 18, 2015 (2 pages).
GenBank Accession No. NP_192187, dated Jan. 22, 2014 (3 pages).
GenBank Accession No. NP_194183, dated Jan. 22, 2014 (4 pages).
GenBank Accession No. NP_195399, dated Jan. 22, 2014 (3 pages).
GenBank Accession No. NP_197872.1, dated Jan. 22, 2014 (2 pages).
GenBank Accession No. P0CE68, dated Jul. 22, 2015 (7 pages).
GenBank Accession No. P12383, dated Jul. 22, 2015 (7 pages).
GenBank Accession No. P12866, dated Jul. 22, 2015 (9 pages).
GenBank Accession No. P13090, dated Jul. 22, 2015 (7 pages).
GenBank Accession No. P25371, dated Jul. 22, 2015 (9 pages).
GenBank Accession No. P32568, dated Jul. 22, 2015 (8 pages).
GenBank Accession No. P33200, dated Jul. 22, 2015 (4 pages).
GenBank Accession No. P33302, dated Jul. 22, 2015 (22 pages).
GenBank Accession No. P33335, dated Jul. 22, 2015 (7 pages).
GenBank Accession No. P36173, dated Jul. 22, 2015 (5 pages).
GenBank Accession No. P38124, dated Jul. 22, 2015 (4 pages).
GenBank Accession No. P38125, dated Jul. 22, 2015 (6 pages).
GenBank Accession No. P38227, dated Jul. 22, 2015 (7 pages).
GenBank Accession No. P38724, dated Jul. 22, 2015 (4 pages).
GenBank Accession No. P38731, dated Jul. 22, 2015 (5 pages).
GenBank Accession No. P38776, dated Jul. 22, 2015 (5 pages).
GenBank Accession No. P39709, dated Jul. 22, 2015 (5 pages).
GenBank Accession No. P39980, dated Jul. 22, 2015 (5 pages).
GenBank Accession No. P40445, dated Jul. 22, 2015 (4 pages).
GenBank Accession No. P40474, dated Jul. 22, 2015 (6 pages).
GenBank Accession No. P40475, dated Jul. 22, 2015 (5 pages).
GenBank Accession No. P40550, dated Jul. 22, 2015 (5 pages).
GenBank Accession No. P41930, dated Jul. 22, 2015 (8 pages).
GenBank Accession No. P50080, dated Jul. 22, 2015 (6 pages).
GenBank Accession No. P51533, dated Jul. 22, 2015 (5 pages).
GenBank Accession No. P53049, dated Jul. 22, 2015 (8 pages).
GenBank Accession No. P53099, dated Jul. 22, 2015 (6 pages).
GenBank Accession No. P53283, dated Jul. 22, 2015 (7 pages).
GenBank Accession No. P53389, dated Jul. 22, 2015 (5 pages).
GenBank Accession No. P53756, dated Jul. 22, 2015 (6 pages).
GenBank Accession No. P53943, dated Jul. 22, 2015 (7 pages).
GenBank Accession No. P54862, dated Jul. 22, 2015 (8 pages).
GenBank Accession No. Q02785, dated Jul. 22, 2015 (10 pages).
GenBank Accession No. Q03263, dated Jul. 22, 2015 (5 pages).
GenBank Accession No. Q04182, dated Jul. 22, 2015 (7 pages).
GenBank Accession No. Q05998, dated Jul. 22, 2015 (6 pages).
GenBank Accession No. Q06149, dated Jul. 22, 2015 (3 pages).
GenBank Accession No. Q06451, dated Jul. 22, 2015 (7 pages).
GenBank Accession No. Q07824, dated Jul. 22, 2015 (10 pages).
GenBank Accession No. Q07904, dated Jul. 22, 2015 (5 pages).
GenBank Accession No. Q08234, dated Jul. 22, 2015 (8 pages).
GenBank Accession No. Q08299, dated Jul. 22, 2015 (6 pages).
GenBank Accession No. Q08409, dated Jul. 22, 2015 (5 pages).
GenBank Accession No. Q08902, dated Jul. 22, 2015 (5 pages).
GenBank Accession No. Q12256, dated Jul. 22, 2015 (8 pages).
GenBank Accession No. Q9UVY5.1, dated Apr. 1, 2015 (3 pages).
Bateman et al., "Pfam 3.1: 1313 multiple alignments and profile HMMs match the majority of proteins," Nucleic Acids Res. 27(1):260-2 (Jan. 1999).
Bay & Turner, "Diversity and evolution of the small multidrug resistance protein family," BMC Evol. Biol. 9:140 (Jun. 2009).
Brachmann et al., "Designer deletion strains derived from *Saccharomyces cerevisiae* S288C: a useful set of strains and plasmids for PCR-mediated gene disruption and other applications," Yeast 14:115-32 (1998).
Chen et al., "Transferring a biosynthetic cycle into a productive *Escherichia coli* strain: large-scale synthesis of galactosides," J. Am. Chem. Soc. 123(36):8866-7 (Sep. 2001).
Chenna et al., "Multiple sequence alignment with the Clustal series of programs," Nucleic Acids Res. 31 (13):3497-500 (Jul. 2003).
GenBank Accession No. AAA23410.1, dated Jun. 11, 1993 (2 pages).
GenBank Accession No. AAB47941.1, dated Feb. 21, 1997 (2 pages).
GenBank Accession No. AAB62280, dated Jul. 2, 1997 (2 pages).
GenBank Accession No. AAB87091, dated Mar. 22, 2000 (2 pages).
GenBank Accession No. AAC28895.1, dated Aug. 6, 1998 (2 pages).
GenBank Accession No. AAC39443, dated Apr. 17, 1998 (2 pages).
GenBank Accession No. AAC39505, dated Jul. 26, 1998 (1 page).
GenBank Accession No. AAD34294, dated Mar. 22, 2000 (2 pages).
GenBank Accession No. AAD34295, dated Mar. 22, 2000 (2 pages).
GenBank Accession No. AAD47596, dated Aug. 9, 1999 (2 pages).
GenBank Accession No. AEE36246, dated Oct. 6, 2014 (3 pages).
GenBank Accession No. AAH69913, dated Jul. 15, 2006 (2 pages).
GenBank Accession No. AAR06912, dated Dec. 28, 2004 (2 pages).
GenBank Accession No. AAR06916.1, dated Dec. 28, 2004 (2 pages).
GenBank Accession No. AAR06920.1, dated Dec. 28, 2004 (2 pages).
GenBank Accession No. AAT70083, dated May 23, 2006 (2 pages).
GenBank Accession No. ABA42921, dated Jun. 21, 2006 (1 page).
GenBank Accession No. ABB88839, dated May 28, 2008 (2 pages).
GenBank Accession No. ABC59076, dated Jun. 6, 2007 (1 page).
GenBank Accession No. ABC98596, dated Jan. 31, 2014 (2 pages).
GenBank Accession No. ABD60225, dated May 28, 2008 (2 pages).
GenBank Accession No. ABD92926, dated Oct. 10, 2007 (2 pages).
GenBank Accession No. AC133334, dated Jan. 31, 2004 (44 pages).
GenBank Accession No. ACD93722, dated Jun. 10, 2008 (1 page).
GenBank Accession No. AF034774, dated Apr. 17, 1998 (2 pages).
GenBank Accession No. AY562490, dated May 23, 2006 (3 pages).
GenBank Accession No. BAA43200, dated Mar. 13, 1999 (2 pages).
GenBank Accession No. BAB59027, dated Jan. 30, 2002 (1 page).
GenBank Accession No. BAE76241.1, dated Nov. 20, 2008 (14 pages).
GenBank Accession No. BAE76318.1, dated Nov. 20, 2008 (14 pages).
GenBank Accession No. BAF61135, dated May 9, 2007 (2 pages).
GenBank Accession No. BAG30962, dated Nov. 12, 2012 (2 pages).
GenBank Accession No. BC153262, dated Oct. 4, 2007 (3 pages).
GenBank Accession No. CAA75568, dated Nov. 14, 2006 (2 pages).
GenBank Accession No. CAA76703, dated Nov. 14, 2006 (1 page).
GenBank Accession No. CAE09055, dated Nov. 14, 2006 (2 pages).
GenBank Accession No. CAG41604, dated Feb. 6, 2015 (2 pages).
GenBank Accession No. EDY51667, dated Sep. 2, 2008 (2 pages).
GenBank Accession No. EU263989, dated Jun. 11, 2008 (2 pages).
GenBank Accession No. DQ398871.3, dated May 28, 2008 (2 pages).

(56) References Cited

OTHER PUBLICATIONS

GenBank Accession No. NM_116512, dated Jan. 22, 2014 (3 pages).
GenBank Accession No. NP_001105097, dated Aug. 4, 2015 (2 pages).
GenBank Accession No. NP_013636.1 (YML075C), dated Jul. 16, 2015 (3 pages).
Boer, "Strain and Process development for fermentative productive of Rebaudiosides", International Specialized Symposium of Yeasts, Abstract, (Jun. 2017).
Mahe et al., "The ATP Binding Cassette Transporters Pdr5 and Snq2 of *Saccharomyces cerevisiae* Can Mediate Transport of Steriods via in Vivo", JBC, 271(41):25167-25172. (Oct. 1996).
Starratt et al., "Rebaudioside F, a diterpene glycoside from Stevia redaudiana", Phytochemistry, 59(4):367-370. (Feb. 2002). Abstract.
Yadav et al ., "Steviol Glycosides from Stevia: Biosynthesis Pathway Review and their Application in Foods and Medicine.", CritRev. 52(11):988-998 (2012).
Sequence alignment between the sequence of Uniprot database entry Q75I83 version 31, updated Jul. 22, 2008 and SEQ ID No. 152 (From European Patent No. 2742142) as cited in Notice of Opposition against EP Application No. 12750513.9; dated Mar. 6, 2017; pp. 102.
Unitprot Accession No. Q75I83, dated Jul. 22, 2008 (pp. 1-2).
Unitprot Accession No. Q75I83, dated Jul. 5, 2004 (pp. 1-4).
Statement of Facts and Arguments in Support of Opposition for EP Application No. 12750513.9; dated Feb. 28, 2017, pp. 1-24.
Notice of Opposition against EP Application No. 12750513.9; dated Mar. 6, 2017. pp. 1-8.
Non-Final Office Action for U.S. Appl. No. 14/648,747, dated Mar. 23, 2017, pp. 1-20.
Third Party Observation in EP Application No. 13801569.8; dated Apr. 26, 2017. pp. 1-5.
International Preliminary Report on Patentability from the International Bureau for International Application PCTEP2015/068314; dated Feb. 14, 2017.
International Search Report and Written Opinion of International Search Authority for International Application No. PCTEP2016/080516; dated Mar. 15, 2017, pp. 1-21.
International Search Report and Written Opinion of International Search Authority for International Application No. PCTEP2017/059028; dated Jun. 27, 2017, pp. 1-15.
Ohta et al., MassBank Accession No. FU000299 (May 2016).
Ohta et al., MassBank Accession No. FU000332 (May 2016).
Kawai et al., "Transformation of *Saccharomyces cerevisiae* and other fungi: methods and possible underlying mechanism," Bioeng Bugs. 1(6):395-403 (2010).
Lin et al., "Arrestin-related ubiquitin-ligase adaptors regulate endocytosis and protein turnover at the cell surface," Cell 135(4):714-25 (2008).
Nagalakshmi et al., "The transcriptional landscape of the yeast genome defined by RNA sequencing," Science 320(5881 ): 1344-9 (2008).
Nikko & Pelham, "Arrestin-mediated endocytosis of yeast plasma membrane transporters," Traffic 10(12):1856-67 (2009).
Garber et al., "Computational methods for transcriptome annotation and quantification using RNA-seq," Nat Methods 8(6):469-77 (2011).
Nikko et al. "Arrestin-like proteins mediate ubiquitination and endocytosis of the yeast metal transporter Smf1," EMBO Rep. 9(12):1216-21 (2008).
Partow et al., "Characterization of different promoters for designing a new expression vector in *Saccharomyces cerevisiae*," Yeast 27:955-64 (2010).
Robinson & Oshlack et al., "A scaling normalization method for differential expression analysis of RNA-seq data", Genome Biol. 11(3):R25 (2010).
Saier Jr. et al., "The transporter classification database," Nucl. Acids Res., 42(1):D251-258 (2014).
Wilhelm et al., "Defining transcribed regions using RNA-seq," Nature Protocols 5:255-66 (2010).
Olsson et al., "Microbial production of next-generation stevia sweeteners," Microbial Cell Factories, 15:11-14 (2016).
Song et al., "The Aspergillus fumigatus 1-29 damage resistance protein family coordinately regulates ergosterol biosynthesis and azole susceptibility," MBIO, 7:1-13 (2016).
Chen, "Summary on Study of Stevioside," China Pharmacist, 10(6):598-599 (2007).
Chen et al., "Sugar transporters for intercellular exchange and nutrition of pathogens," Nature 468(7323):527-32 (2010).
Daran et al., "Genetic and biochemical characterization of the UGP1 gene encoding the UDP-glucose pyrophosphorylase from *Saccharomyces cerevisiae*," Eur J Biochem. 233(2):520-30 (Jul. 1995).
Husar et al., "Overexpression of the UGT73C6 alters brassinosteriod glucoside formation in *Arabidopsis thaliana*", BMC Plant Biology, 11:1-14 (2011).
Malonek et al., "The NADPH-cytochrome P450 Reductase Gene from Gibberalla fujikuroi is Essential for Gibberellin Biosynthesis", J Bio Chem. 279(24):25075-84 (Jun. 2004).
Mao et al., "Produce steviol glycosides in engineered yeast, 2015 Synthetic Biology: Engineering, Evolution & Design (Seed)", Poster Abstract (Jun. 2015).
Nagatoshi et al., "UGT75L6 and UGT94E5 mediate sequential glucosylation of crocetin to crocin in Gardenia asminoides", FEBS Letters, 586:1055-1061 (2012).
Tiwari et al., "Plant secondary metabolism linked glycosyltransferases: An update on expanding knowledge and scopes", Biotechnology Advances, 34:714-739 (May 2016).
Wang et al., "Pathway mining-based integration of critical enzyme parts for de novo biosynthesis of steviol glycoside sweetener in *Escherichia coli*", Cell Research, 26:258-261 (Sep. 2015).
Wang et al., "Efficient enzymatic production of rebaudioside A from stevioside", Bioscience, Biotechnology, and Biochemistry, 80:67-73 (Aug. 2015).
Wang et al., "RNA-Seq: a revolutionary tool for transcriptomics," Nat Rev Genet. 10(1):57-63 (2009).
Wang et al., "Design and construction of artificial biological systems for complex natural products biosynthesis", Chinese Journal of Biotechnology, 29:114-1160, (2013).
Warth et al., "Hydrophilic interaction liquid chromatography coupled with tandem mass spectrometry for the quantification of uridine diphosphate-glucose, uridine diphosphate-glucuronic acid, deoxynivalenol and its glucoside: In-house validation and application to wheat," Journal of Chromatography A, 1423, pp. 183-189 (2015).
Yang Quanhua et.al., "Analysis of the Chemical constituents of Stevia rebaudiana and its sweetness," Journal of Beijing University of Chemical Technology, vol. 39, No. 2., p. 28-32 (2012) (English Abstract).
Yang et al., "Base substitution mutations in uridinediphosphate-dependent glycosyltransferase 76G1 gene of Stevia rebaudioside A; Mustation in UGT76G1, a key gene of steviol glycoside synthesis", Plant Physiology and Biochemistry, 80:220-225 (2014).
Examination Report issued by the European Patent Office for European Application No. 12750513.9, dated Nov. 26, 2014.
Non-Final Office Action for U.S. Appl. No. 14/761,629, dated Mar. 21, 2017 (pp. 1-19).
Final Office Action for U.S. Appl. No. 14/761,629, dated Aug. 11, 2017 (pp. 1-16).
Non-Final Office Action for U.S. Appl. No. 14/764,898, dated Mar. 30, 2017, pp. 1-17.
Final Office Action for U.S. Appl. No. 14/648,747, dated Sep. 6, 2017, pp. 1-19.
International Search Report of International Search Authority for International Application No. PCT/EP2017/055589; dated May 12, 2017, pp. 1-5.
Written Opinion of International Search Authority for International Application No. PCT/EP2017/055589; dated May 12, 2017, pp. 1-8.
International Search Report of the International Searching Authority for International Application No. PCT/EP2017/061774; dated Aug. 30, 2017, pp. 1-8.

(56) References Cited

OTHER PUBLICATIONS

Written Opinion of the International Searching Authority for International Application No. PCT/EP2017/061774; dated Aug. 30, 2017, pp. 1-13.
International Search Report of International Search Authority for International Application No. PCTEP2017/061775; dated Sep. 6, 2017, pp. 1-5.
Written Opinion of International Search Authority for International Application No. PCTEP2017/061775; dated Sep. 6, 2017, pp. 1-8.
Chen et al., "Fusion protein linkers: Property, design, and functionality", Advanced Drug Delivery reviews, 65 (0):1257-69 (2013).
Third Party Observation in EP Application No. 13801569.8; dated Oct. 23, 2017. pp. 1-6.

* cited by examiner

Figure 4
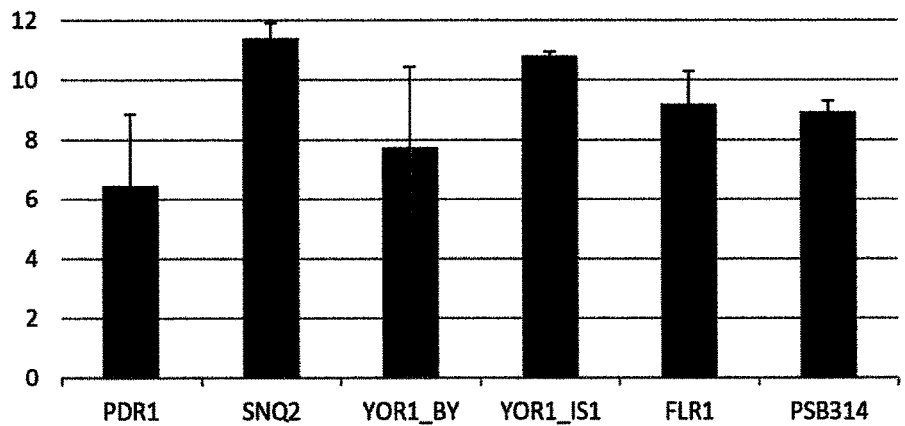
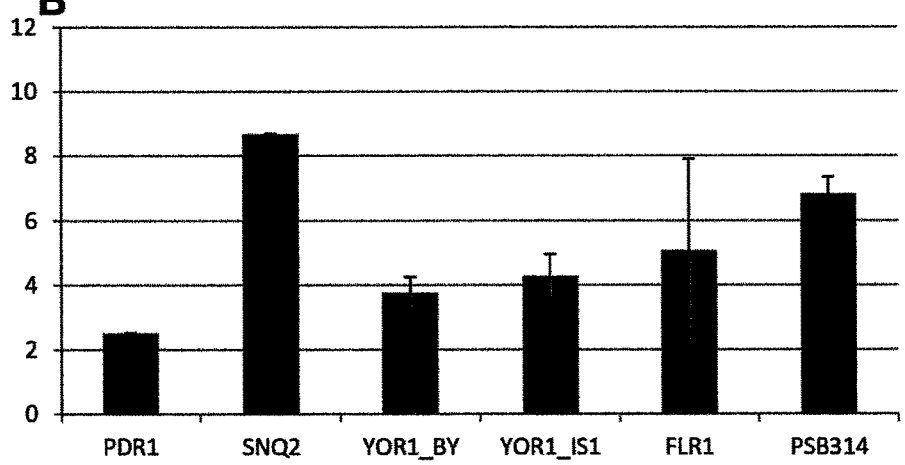
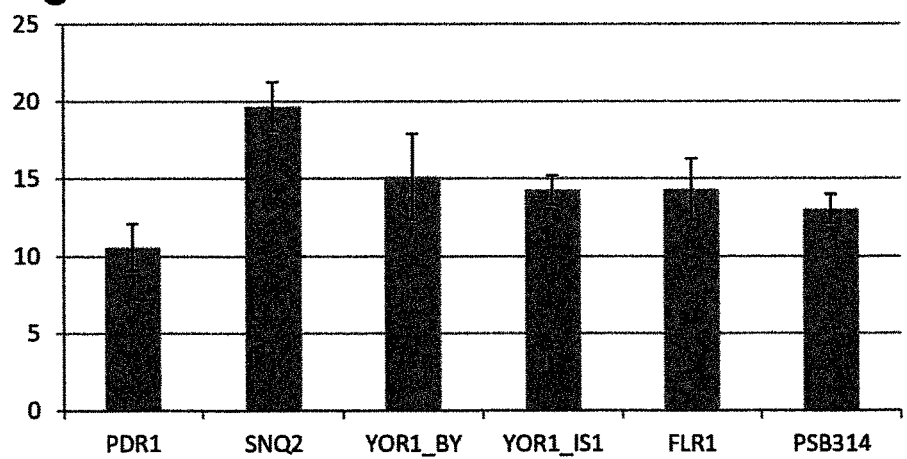

Figure 4
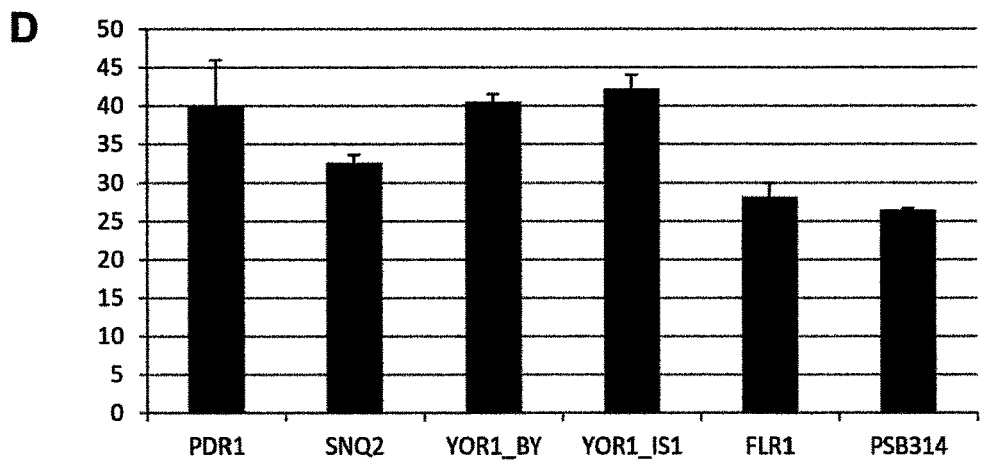
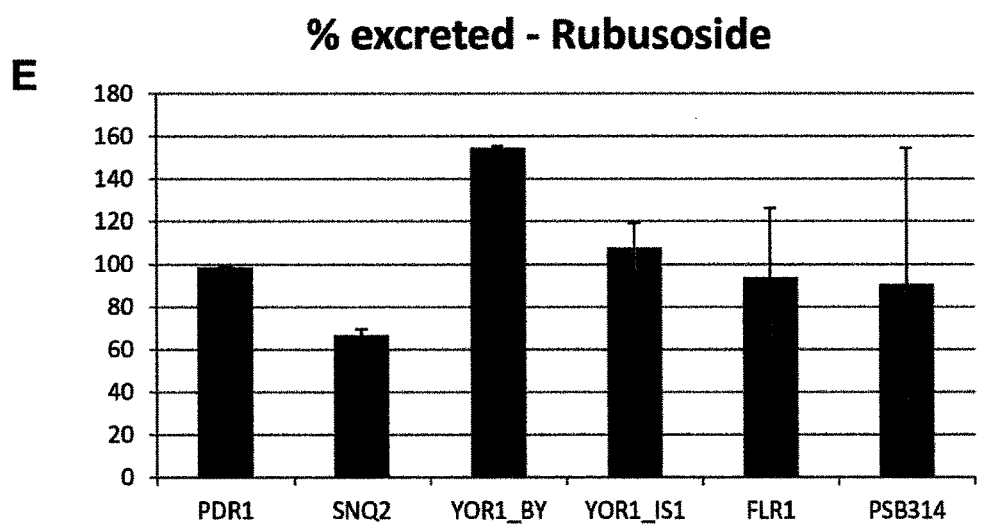
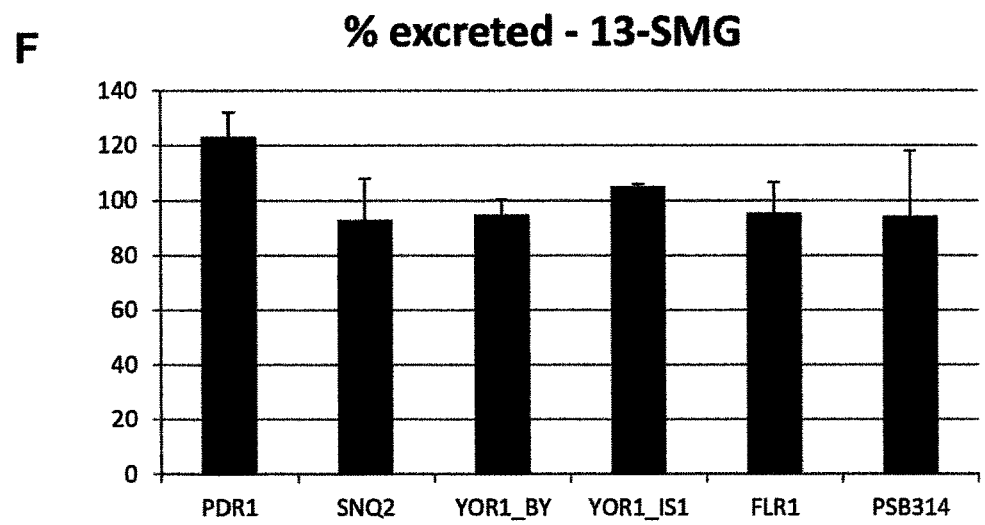

Figure 4
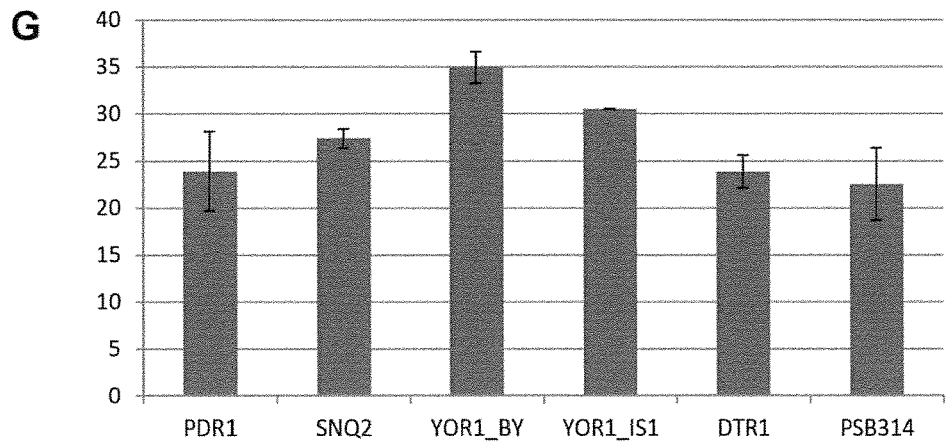
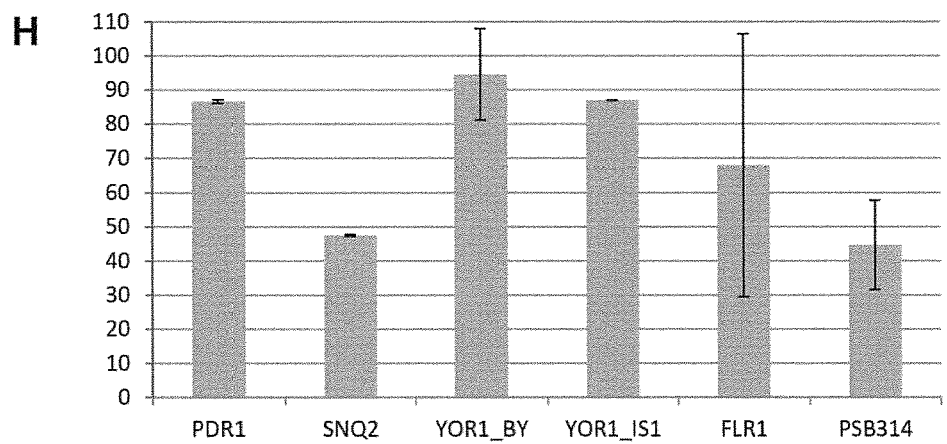
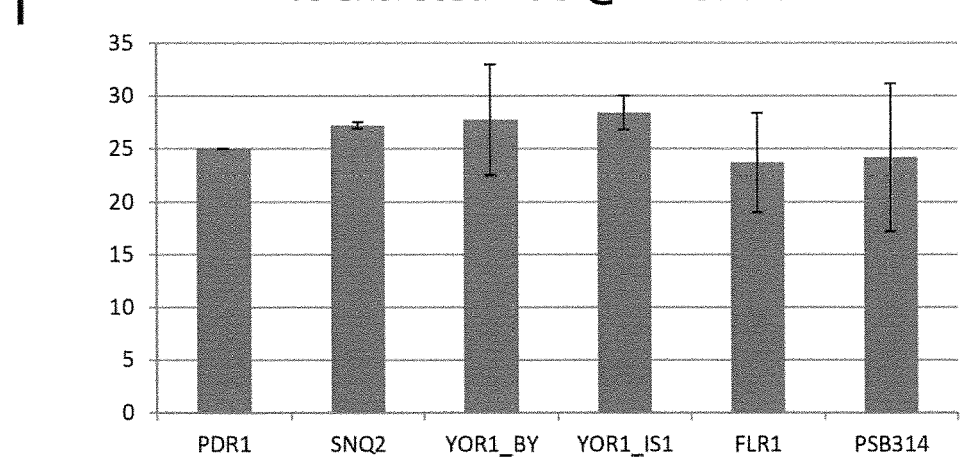

Figure 4
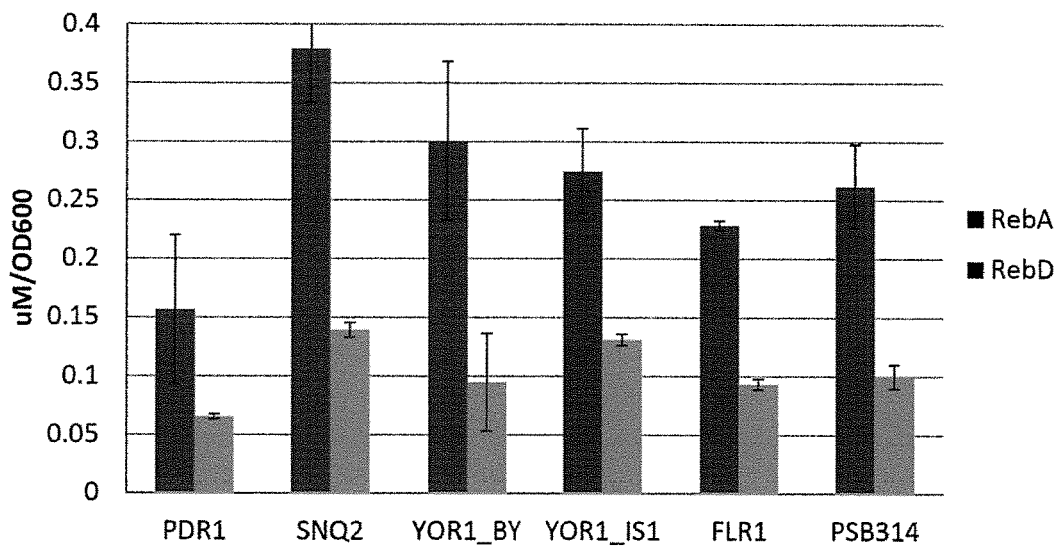
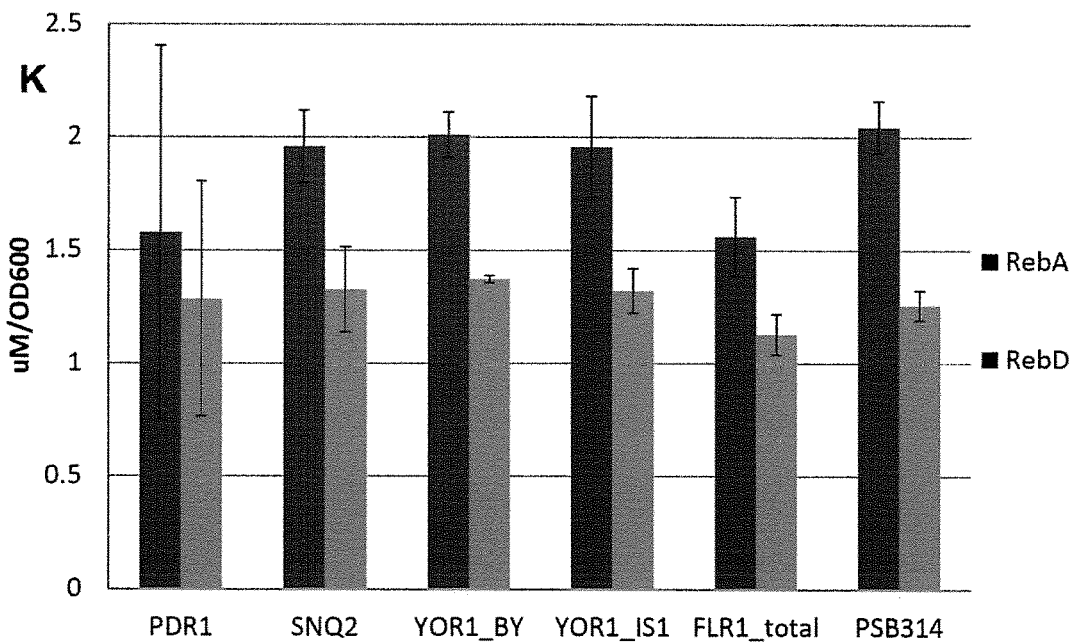

Figure 4
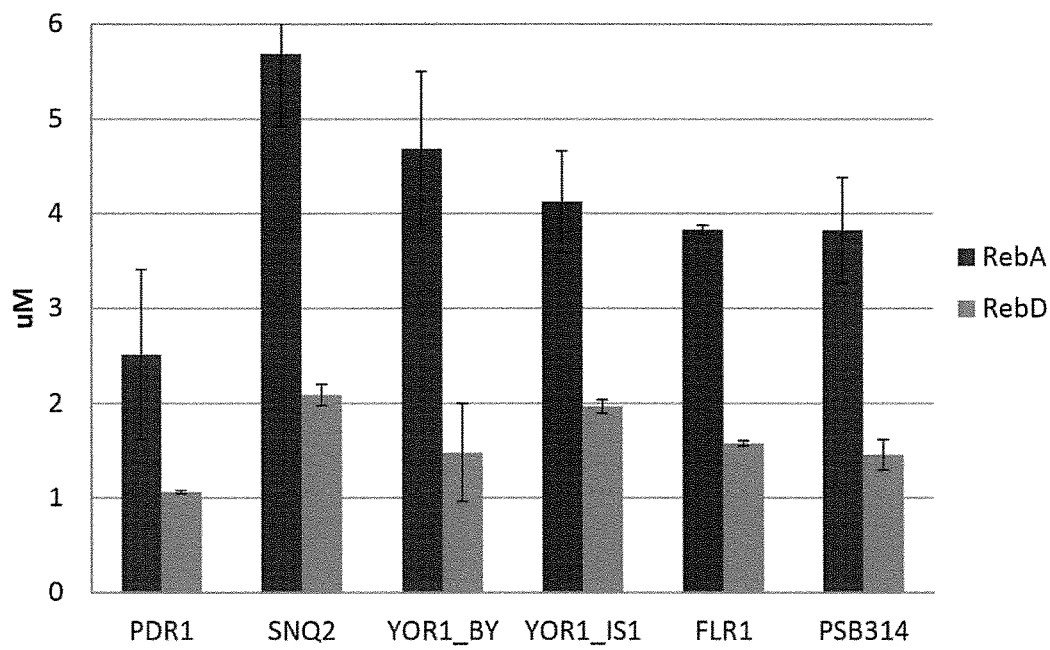
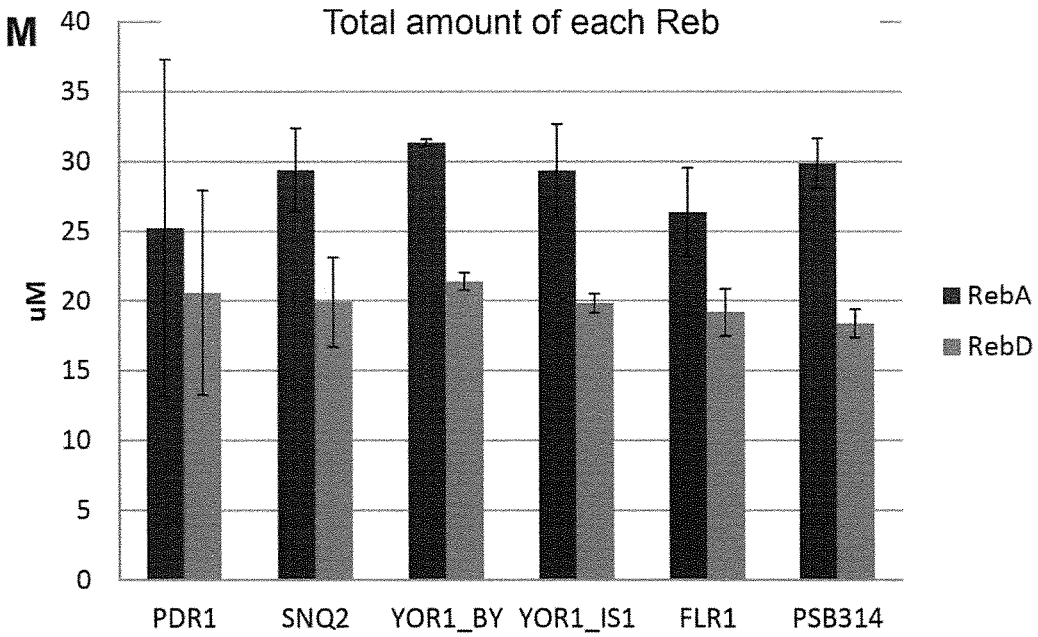

Figure 5
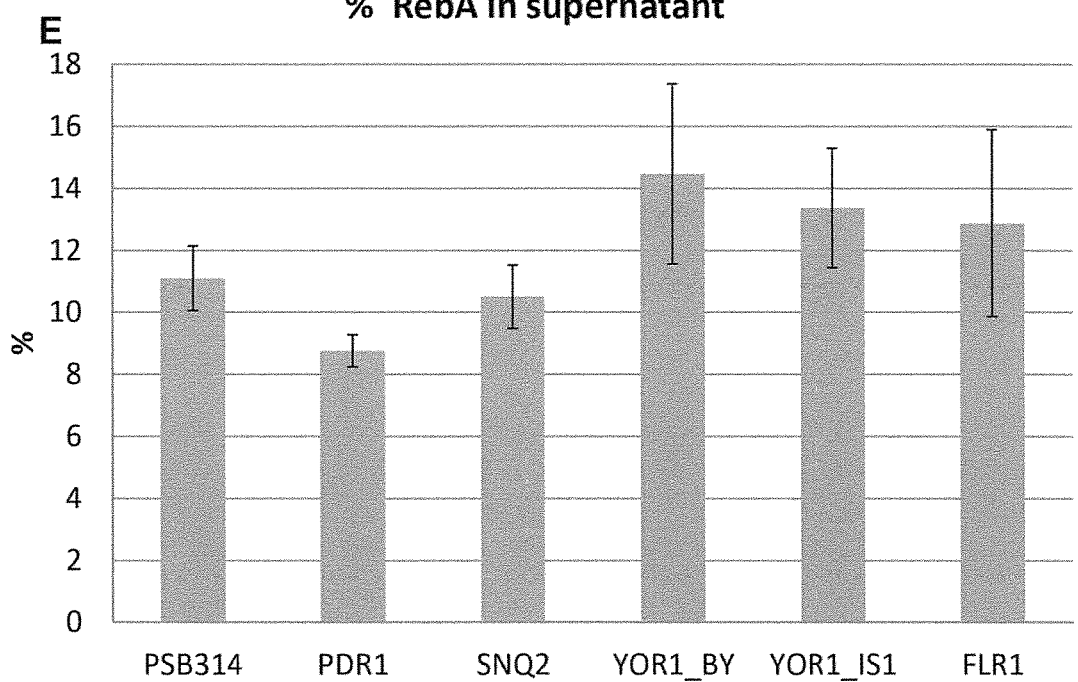
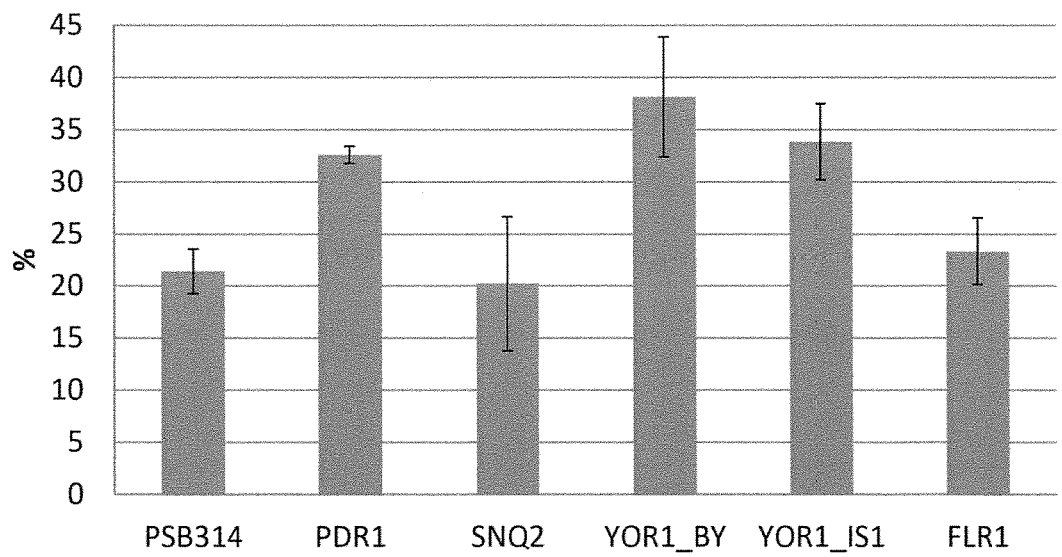

Figure 5
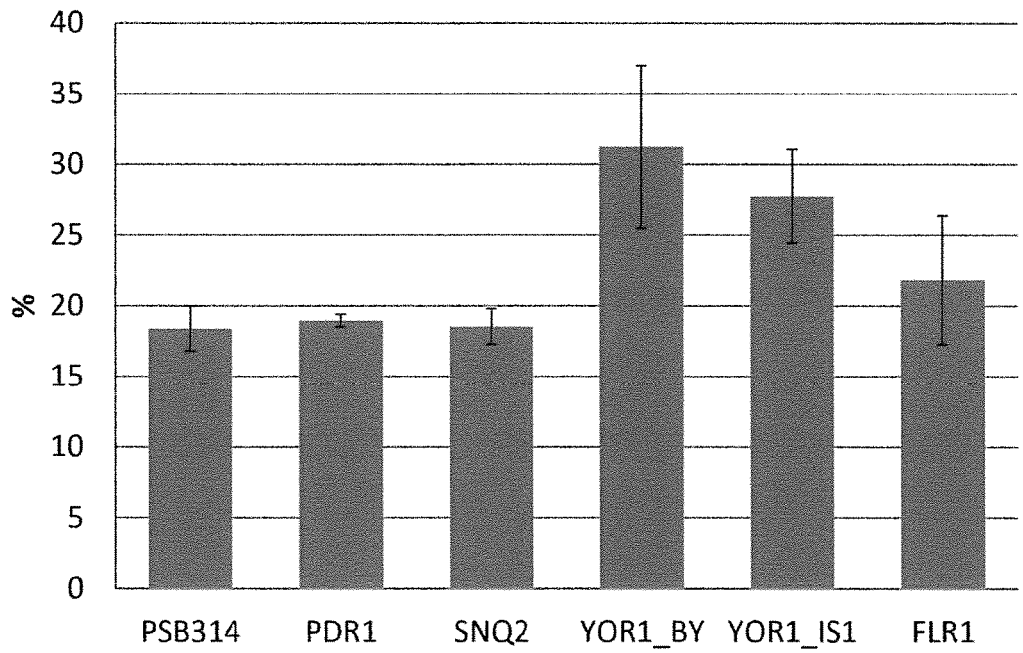
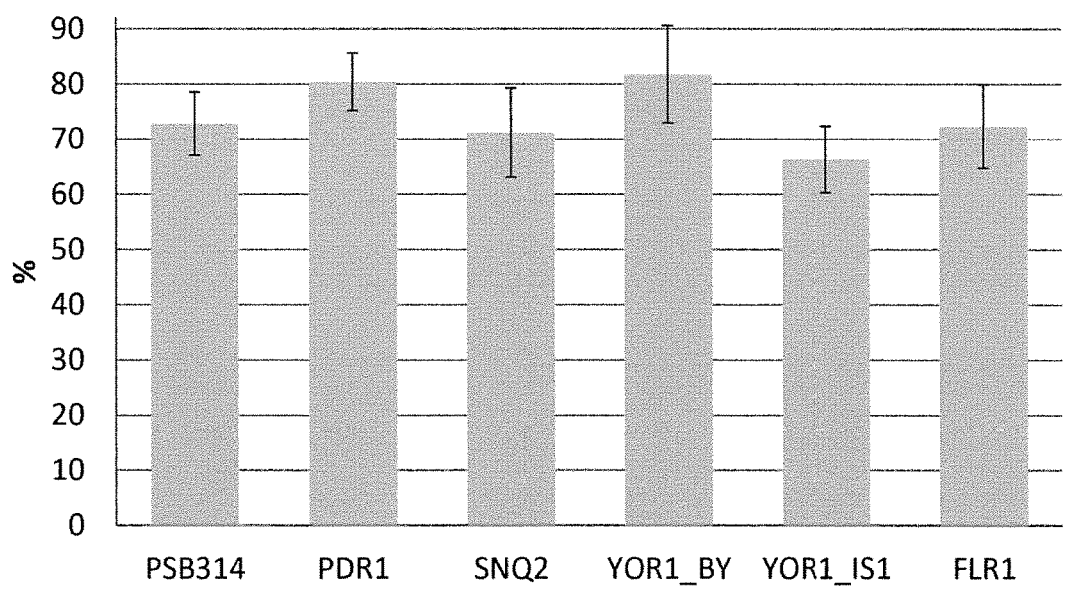

Figure 13
A
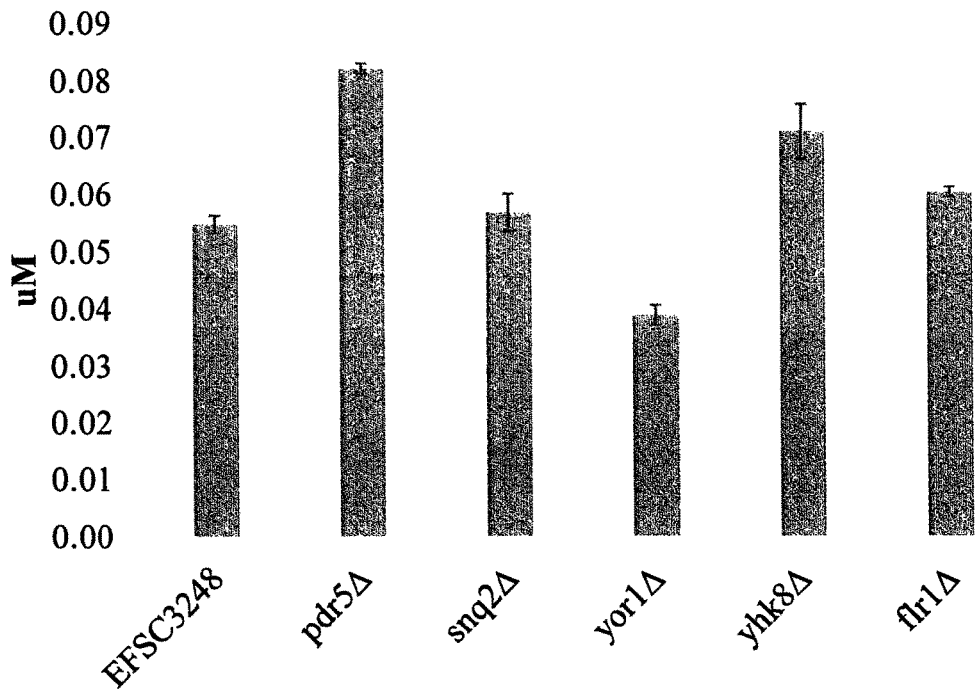
B
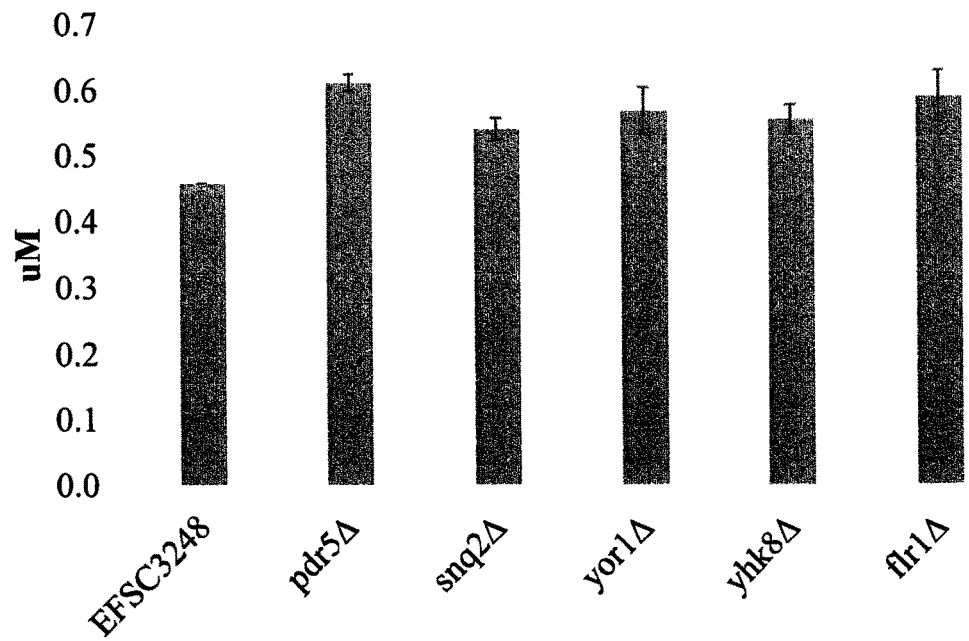

Figure 13
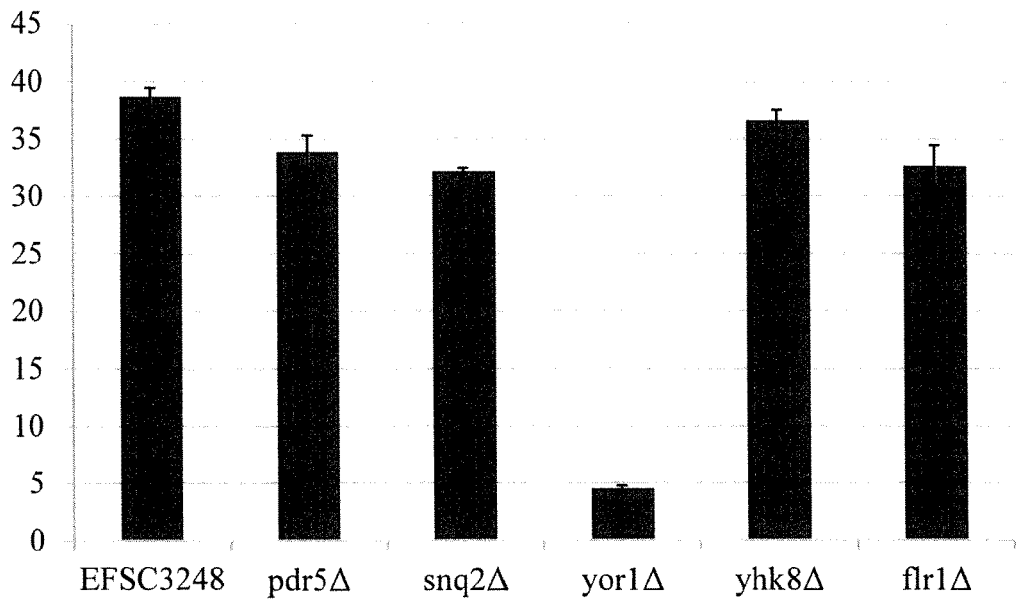
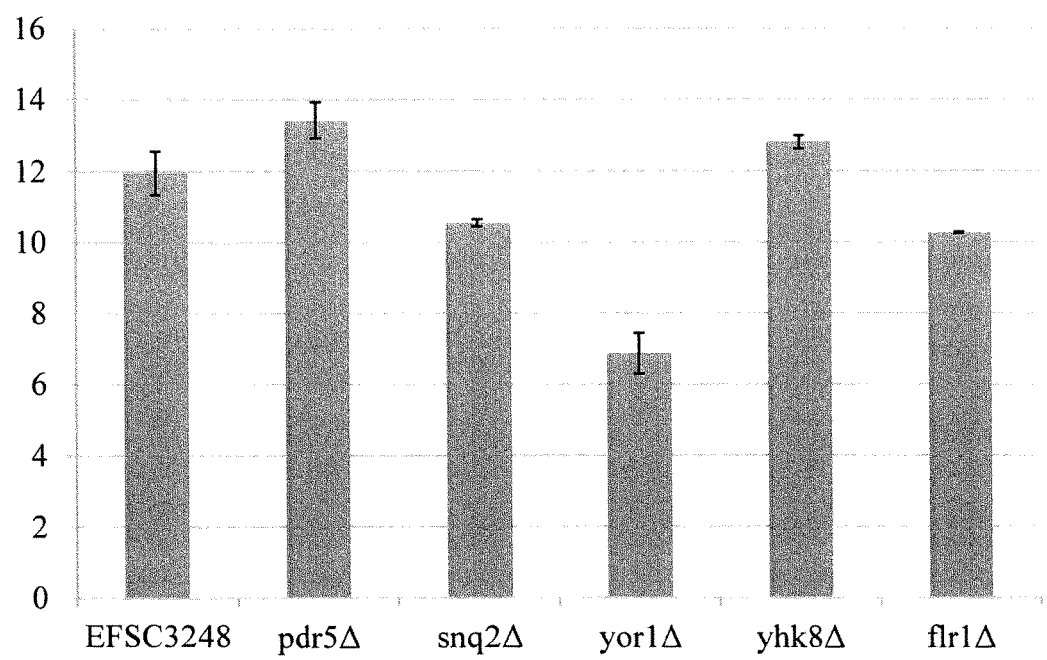

EFFICIENT PRODUCTION OF STEVIOL GLYCOSIDES IN RECOMBINANT HOSTS

CROSS-REFERENCE TO RELATED APPLICATIONS

This application claims the benefit of U.S. Provisional Application No. 61/763,290, filed Feb. 11, 2013, and U.S. Provisional Application No. 61/763,308, filed Feb. 11, 2013, the disclosures of each of which are incorporated by reference.

TECHNICAL FIELD

This disclosure relates to the recombinant production of steviol glycosides and isolation methods thereof. In particular, this disclosure relates to the production of steviol glycosides such as rebaudioside A (RebA), rebaudioside B (RebB), rebaudioside D (RebD), rebaudioside E (RebE) and rebaudioside M (RebM) by recombinant hosts such as recombinant microorganisms. This disclosure also relates to modifications to transport systems in the recombinant host to increase production, excretion or both of such steviol glycosides.

BACKGROUND

Sweeteners are well known as ingredients used most commonly in the food, beverage, or confectionary industries. The sweetener can either be incorporated into a final food product during production or for stand-alone use, when appropriately diluted, as a tabletop sweetener or an at-home replacement for sugars in baking. Sweeteners include natural sweeteners such as sucrose, high fructose corn syrup, molasses, maple syrup, and honey and artificial sweeteners such as aspartame, saccharine and sucralose. *Stevia* extract is a natural sweetener that can be isolated and extracted from a perennial shrub, *Stevia rebaudiana*. *Stevia* is commonly grown in South America and Asia for commercial production of *stevia* extract. *Stevia* extract, purified to various degrees, is used commercially as a high intensity sweetener in foods and in blends or alone as a tabletop sweetener.

Extracts of the *Stevia* plant contain rebaudiosides and other steviol glycosides that contribute to the sweet flavor, although the amount of each glycoside often varies among different production batches. Typically, stevioside and rebaudioside A are the primary compounds in commercially-produced *stevia* extracts. Stevioside is reported to have a more bitter and less sweet taste than rebaudioside A. The composition of *stevia* extract can vary from lot to lot depending on the soil and climate in which the plants are grown. Depending upon the sourced plant, the climate conditions, and the extraction process, the amount of rebaudioside A in commercial preparations is reported to vary from 20 to 97% of the total steviol glycoside content. Other steviol glycosides are present in varying amounts in *stevia* extracts. For example, rebaudioside B is typically present at less than 1-2%, whereas rebaudioside C can be present at levels as high as 7-15%. Rebaudioside D is typically present in levels of 2% or less, Rebaudioside M is typically present in trace levels (<0.1%), and rebaudioside F is typically present in compositions at 3.5% or less of the total steviol glycosides. The amount of the minor steviol glycosides can affect the flavor profile of a *Stevia* extract.

Chemical structures for several of the compounds found in *Stevia* extracts are shown in FIG. 1, including the diterpene steviol and various steviol glycosides. CAS numbers are shown in Table 1 below. See also, Steviol Glycosides Chemical and Technical Assessment 69th JECFA, prepared by Harriet Wallin, Food Agric. Org. (2007).

TABLE 1

| COMPOUND | CAS # |
| --- | --- |
| Steviol | 471-80-7 |
| Rebaudioside A (RebA) | 58543-16-1 |
| Steviolbioside | 41093-60-1 |
| Stevioside | 57817-89-7 |
| Rebaudioside B (RebB) | 58543-17-2 |
| Rebaudioside C (RebC) | 63550-99-2 |
| Rebaudioside D (RebD) | 63279-13-0 |
| Rebaudioside E (RebE) | 63279-14-1 |
| Rebaudioside F (RebF) | 438045-89-7 |
| Rebaudioside M (RebM) | 1220616-44-3 |
| Rubusoside (Rubu) | 63849-39-4 |
| Dulcoside A | 64432-06-0 |

SUMMARY

This document describes materials and methods that can be used to efficiently produce steviol glycoside compositions, by modification of transport systems in the recombinant host that are involved in excretion of steviol glycosides. In some embodiments, recombinant hosts described herein can produce at least one steviol glycoside and express a heterologous transporter such as a transporter that actively excretes antibiotics. In some embodiments, recombinant hosts described herein produce at least one steviol glycoside and the expression of an endogenous transporter gene is altered in the host and/or expression of a transcription factor gene is altered, wherein the transcription factor regulates expression of at least one endogenous transporter gene. Altering expression of endogenous transporters that actively secrete antibiotics is particularly useful. In some embodiments, expression of a plurality of endogenous transporter genes, transcription factor genes, or both is altered. Such recombinant hosts can include one or more biosynthesis genes whose expression results in production of steviol glycosides such as rebaudioside A, rebaudioside B, rebaudioside D, rebaudioside E, or rebaudioside M. Such biosynthesis genes include 13-monoglucoside beta 1,2 glycosyl-transferases and/or 19-monoglucoside-beta 1,2-glucosyltransferases (e.g., 91D2e and EUGT11) and other UDP glycosyl transferases such as UGT74G1, UGT76G1, and/or UGT85C2, to allow the production of steviol glycosides in recombinant hosts.

This document also features methods for producing a steviol glycoside product. These methods include fermentation methods using a recombinant microorganism (e.g., *Saccharomyces cerevisiae*) having altered expression of an endogenous transporter gene to produce the steviol glycoside, which, optionally, then can be purified from the fermentation broth.

In one aspect, this document features methods for identifying a gene or genes that affect excretion of a steviol glycoside as well as using recombinant embodiments thereof to genetically engineer recombinant cells, particularly microorganisms, to produce steviol glycosides as set forth herein. These methods include modifying expression of at least one endogenous transporter in a recombinant microorganism capable of producing steviol or a steviol glycoside; culturing the modified microorganism in a medium under conditions in which the steviol glycoside is synthesized; and measuring the amount of extracellular and/or intracellular steviol glycoside produced during the culturing step relative to the amount produced by a corresponding microorganism lacking the modification, thereby identifying the endogenous transporter as affecting excretion of the steviol glycoside.

This document also features alternative methods for identifying a gene or genes that affect excretion of a steviol glycoside as well as using recombinant embodiments thereof to genetically engineer recombinant cells, particularly microorganisms, to produce steviol glycosides as set forth herein. The method includes modifying expression of at least one endogenous transporter in a microorganism to generate a modified microorganism; introducing one or more recombinant genes capable of producing a steviol glycoside into the modified microorganism; culturing the modified microorganism in a medium under conditions in which the steviol glycoside is synthesized; and measuring the amount of extracellular and/or intracellular steviol glycoside produced during the culturing step relative to the amount produced by a corresponding microorganism lacking the modification, thereby identifying the endogenous transporter as affecting excretion of the steviol glycoside.

This document also features yet additional methods for identifying a gene or genes affecting excretion of a steviol glycoside. These methods include modifying expression of at least one endogenous transcription factor that regulates expression of an endogenous transporter gene in a recombinant microorganism capable of producing steviol or a steviol glycoside; culturing the modified microorganism in a medium under conditions in which the steviol glycoside is synthesized; and measuring the amount of extracellular and/or intracellular steviol glycoside produced during the culturing step relative to the amount produced by a corresponding microorganism lacking the modification, thereby identifying the transcription factor as affecting excretion of the steviol glycoside.

In another embodiment, this document features still further methods for identifying a gene or genes affecting excretion of a steviol glycoside. These methods include modifying expression of at least one endogenous transcription factor that regulates expression of an endogenous transporter gene in a microorganism to generate a modified microorganism; introducing one or more recombinant genes capable of producing a steviol glycoside into the modified microorganism; culturing the modified microorganism in a medium under conditions in which the steviol glycoside is synthesized; and measuring the amount of extracellular and/or intracellular steviol glycoside produced during the culturing step relative to the amount produced by a corresponding microorganism lacking the modification, thereby identifying the transcription factor as affecting excretion of the steviol glycoside.

In another aspect, this document relates to methods of increasing excretion of steviol glycosides by modifying expression of a gene or genes identified to affect excretion of a steviol glycoside, wherein the expression of the identified genes would be modified in recombinant microorganisms capable of producing steviol or a steviol glycoside. In some embodiments the gene or genes identified are endogenous genes that can be overexpressed or repressed by replacing the endogenous promoter with a stronger promoter or weaker promoter, respectively, as compared to the wild-type promoter. In other embodiments, the gene or genes identified can be endogenous genes that are overexpressed or repressed by introducing exogenous DNA engineered to overexpress or repress the endogenous gene or genes. In yet another embodiment, homologous or orthologous genes of an identified endogenous gene can be overexpressed. In a further embodiment, the endogenous gene can be induced to be overexpressed or repressed using native mechanisms to the recombinant microorganism (e.g. heat shock, stress, heavy metal or antibiotic exposure).

In any of the methods described herein, modifying expression can include increasing or decreasing expression or activity of the endogenous transporter or transcription factor at least 5% above or below the level of expression observed in a corresponding unmodified microorganism.

In any of the methods described herein, the recombinant genes can include one or more of the following genes encoded by exogenous nucleic acids:
(a) one or more recombinant genes encoding a sucrose transporter and a sucrose synthase;
(b) a nucleic acid encoding a GGPPS polypeptide;
(c) a nucleic acid encoding an ent-copalyl diphosphate synthase polypeptide;
(d) a nucleic acid encoding a kaurene synthase (KS) polypeptide;
(e) a nucleic acid encoding a kaurene oxidase (KO) polypeptide;
(f) a nucleic acid encoding a steviol synthase (KAH) polypeptide;
(g) a nucleic acid encoding a cytochrome P450 reductase (CPR) polypeptide; and also in appropriate combination,
(h) a nucleic acid encoding a UGT85C2 polypeptide;
(i) a nucleic acid encoding a UGT76G1 polypeptide;
(j) a nucleic acid encoding a UGT74G1 polypeptide;
(k) a nucleic acid encoding a UGT91D2 polypeptide; or
(l) a nucleic acid encoding a EUGT11 polypeptide.

This document features methods for identifying a gene or genes affecting excretion of a steviol glycoside as well as using recombinant embodiments thereof to genetically engineer recombinant cells, particularly microorganisms, to produce steviol glycosides as set forth herein. The method includes expressing at least one heterologous transporter in a recombinant microorganism capable of producing steviol or a steviol glycoside; culturing the microorganism in a medium under conditions in which the steviol glycoside is synthesized; and measuring the amount of extracellular and/or intracellular steviol glycoside produced during the culturing step relative to the amount produced by a corresponding microorganism lacking the modification, thereby identifying a heterologous transporter affecting excretion of the steviol glycoside. The heterologous transporter can be a *Stevia* transporter.

In any of the methods described herein, the microorganism can include, but is not limited to suitable species from a genus selected from the group consisting of *Agaricus, Aspergillus, Bacillus, Candida, Corynebacterium, Escherichia, Fusarium/Gibberella, Kluyveromyces, Laetiporus, Lentinus, Phaffia, Phanerochaete, Pichia, Physcomitrella, Rhodoturula, Saccharomyces, Schizosaccharomyces, Sphaceloma, Xanthophyllomyces* and *Yarrowia*. Exemplary species from such genera include, but are not limited to, *Saccharomyces cerevisiae, Schizosaccharomyces pombe, Yarrowia lipolytica, Candida glabrata, Ashbya gossypii, Cyberlindnera jadinii, Pichia pastoris, Kluyveromyces lactis, Hansenula polymorphs, Candida boidinii, Arxula adeninivorans, Xanthophyllomyces dendrorhous* or *Candida albicans* species.

These and other features and advantages of the present invention will be more fully understood from the following detailed description of the invention taken together with the accompanying claims. It is noted that the scope of the claims is defined by the recitations therein and not by the specific discussion of features and advantages set forth in the present description.

DESCRIPTION OF DRAWINGS

FIG. 4A-M is a bar graph of the percent excreted (FIG. 4A-I) or micromolar/OD600 (FIG. 4 J-K) or micromolar concentration (FIG. 4L-M) of each steviol glycocoside in the supernatant or total amount, as indicated in each figure, of the various transporters overexpressed on a 2 micron plasmid in the yeast strain EFSC2797 compared to a yeast strain containing empty plasmid (PSB314). Endogenous yeast transporter genes PDR1, PDR3, PDR13, SNQ2, YOR1_BY, YOR1_IS1, FLR1, AZR1 and DTR1 were overexpressed using the PSB314 plasmid in the EFSC2797 Reb producing strain and the content of each steviol glycoside was measured in the pellet and the supernatant fraction by LC-MS.

DETAILED DESCRIPTION

Figure 1:
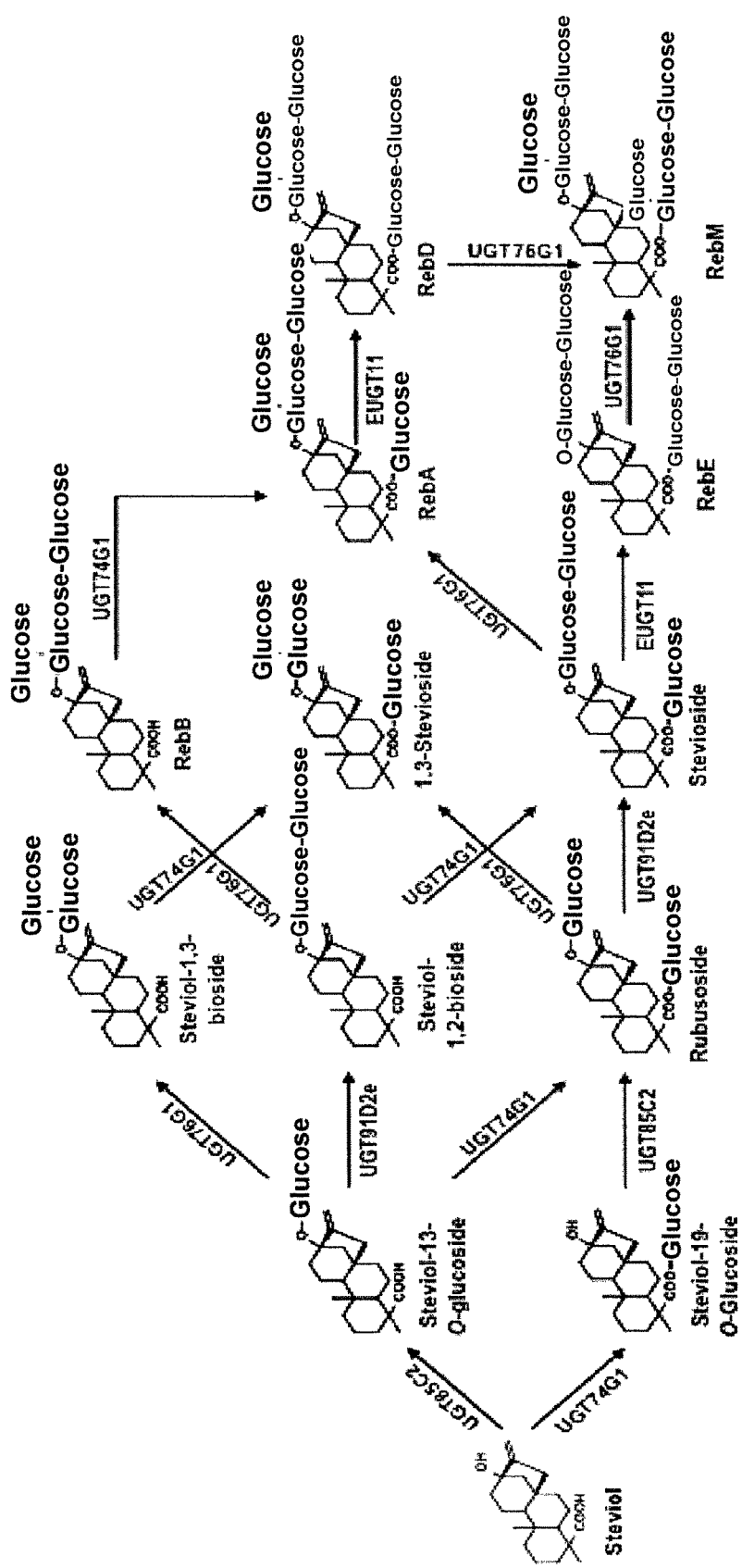
FIG. 1 shows the chemical structures and synthesis pathways for various steviol glycosides.

Unless otherwise defined, all technical and scientific terms used herein have the same meaning as commonly understood by one of ordinary skill in the art to which the invention belongs. Although methods and materials similar or equivalent to those described herein can be used to practice the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and are not intended to be limiting. Other features and advantages of the invention will be apparent from the following detailed description. Applicants reserve the right to alternatively claim any disclosed invention using the transitional phrase "comprising," "consisting essentially of," or "consisting of," according to standard practice in patent law.

Methods well known to those skilled in the art can be used to construct genetic expression constructs and recombinant cells according to this invention. These methods include in vitro recombinant DNA techniques, synthetic techniques, in vivo recombination techniques, and polymerase chain reaction (PCR) techniques. See, for example, techniques as described in Maniatis et al., 1989, MOLECULAR CLONING: A LABORATORY MANUAL, Cold Spring Harbor Laboratory, New York; Ausubel et al., 1989, CURRENT PROTOCOLS IN MOLECULAR BIOLOGY, Greene Publishing Associates and Wiley Interscience, New York; and PCR Protocols: A Guide to Methods and Applications (Innis et al., 1990, Academic Press, San Diego, Calif.).

Before describing the present invention in detail, a number of terms will be defined. As used herein, the singular forms "a", "an", and "the" include plural referents unless the context clearly dictates otherwise. For example, reference to a "nucleic acid" means one or more nucleic acids.

It is noted that terms like "preferably", "commonly", and "typically" are not utilized herein to limit the scope of the claimed invention or to imply that certain features are critical, essential, or even important to the structure or function of the claimed invention. Rather, these terms are merely intended to highlight alternative or additional features that can or cannot be utilized in a particular embodiment of the present invention.

For the purposes of describing and defining the present invention it is noted that the term "substantially" is utilized herein to represent the inherent degree of uncertainty that can be attributed to any quantitative comparison, value, measurement, or other representation. The term "substantially" is also utilized herein to represent the degree by which a quantitative representation can vary from a stated reference without resulting in a change in the basic function of the subject matter at issue.

As used herein, the terms "polynucleotide", "nucleotide", "oligonucleotide", and "nucleic acid" can be used interchangeably to refer to nucleic acid comprising DNA, RNA, derivatives thereof, or combinations thereof.

As used herein, the term "and/or" is utilized to describe multiple components in combination or exclusive of one another. For example, "x, y, and/or z" can refer to "x" alone, "y" alone, "z" alone, "x, y, and z," "(x and y) or z," "x and (y or z)," or "x or y or z." In some embodiments, "and/or" is used to refer to the exogenous nucleic acids that a recombinant cell comprises, wherein a recombinant cell comprises one or more exogenous nucleic acids selected from a group. In some embodiments, "and/or" is used to refer to production of steviol glycosides, wherein one or more steviol glycosides selected from a group are produced. In some embodiments, "and/or" is used to refer to production of steviol glycosides, wherein one or more steviol glycosides are produced through one or more of the following steps: culturing a recombinant microorganism, synthesizing one or more steviol glycosides in a recombinant microorganism, and isolating one or more steviol glycosides.

This document describes materials and methods that can be used to efficiently produce steviol glycoside compositions, by modification of transport systems in the recombinant host that are involved in excretion of steviol glycosides. In some embodiments, recombinant hosts described herein can produce at least one steviol glycoside and express a heterologous transporter such as a transporter that actively excretes antibiotics. In some embodiments, recombinant hosts described herein produce at least one steviol glycoside and the expression of an endogenous transporter gene is altered in the host and/or expression of a transcription factor gene is altered, wherein the transcription factor regulates expression of at least one endogenous transporter gene. Altering expression of endogenous transporters that actively secrete antibiotics is particularly useful. In some embodiments, expression of a plurality of endogenous transporter genes, transcription factor genes, or both is altered. Such recombinant hosts can include one or more biosynthesis genes whose expression results in production of steviol glycosides such as rebaudioside A, rebaudioside B, rebaudioside D, rebaudioside E or rebaudioside M. Such biosynthesis genes include 13-monoglucoside beta 1,2 glycosyltransferases and/or 19-monoglucoside-beta 1,2-glucosyltransferases (e.g., UGT91D2e and EUGT11) and other UDP glycosyl transferases such as UGT74G1, UGT76G1, and/or UGT85C2, to allow the production of steviol glycosides in recombinant hosts.

In one aspect, this document relates to a recombinant microorganism capable of synthesizing at least one steviol glycoside comprising modified expression of at least one gene that is a transporter gene, a transcription factor gene that regulates expression of at least one transporter gene, or both. In one embodiment, the transporter gene can be an endogenous transporter gene or a heterologous transporter gene. In another embodiment, the transporter gene can encodes an ABC transporter or an MFS transporter, wherein the transporter gene transporter gene or transcription factor gene is PDR1, PDR3, PDR5, PDR8, PDR10, PDR11, PDR12, PDR15, PDR18, YOR1, AUS1, SNQ2, PDR12, STE6, THI73, NFT1, ADP1, FLR1, QDR1, QDR2, QDR3, DTR1, TPO1, TPO2, TPO4, TPO3, AQR1, AZR1, ENB1, SGE1, YHK8, GEX2, HOL1, ATR1, HXT11, ENB1, ARN1, ARN2, SSU1, THI7, TPN1, SEO1, SIT1 or DTR1.

In another embodiment, the modified expression of a target gene in the recombinant mircroorganism comprises overexpressing or reduced expression of the transporter gene or the transcription factor gene. In yet another embodiment, the recombinant microorganism comprises overexpressing or reduced expression of a plurality of endogenous transporter genes or transcription factor genes. In one embodiment, the recombinant microorganism comprises reduced expression of PDR5, PDR10, PDR15 and SNQ2 genes by disrupting each gene locus. In another embodiment, the recombinant microorganism comprises reduced expression of PDR1, PDR3, PDR5, PDR10, PDR15, SNQ2 and TPO1 genes by disrupting each gene locus.

In a further embodiment, the recombinant microorganism of this document comprises one or more of the following exogenous nucleic acids: one or more recombinant genes encoding a sucrose transporter and a sucrose synthase; a nucleic acid encoding a GGPPS polypeptide; a nucleic acid encoding an ent-copalyl diphosphate synthasepolypeptide; a nucleic acid encoding a kaurene synthase (KS) polypeptide; a nucleic acid encoding a kaurene oxidase (KO) polypeptide; a nucleic acid encoding a steviol synthase (KAH) polypeptide; a nucleic acid encoding a cytochrome P450 reductase (CPR)polypeptide; a nucleic acid encoding a UGT85C2 polypeptide; a nucleic acid encoding a UGT76G polypeptide; a nucleic acid encoding a UGT74G1 polypeptide; a nucleic acid encoding a UGT91D2 polypeptide; or a nucleic acid encoding a EUGT11 polypeptide. In one embodiment, the recombinant microorganism, comprises the exogenous nucleic acids encoding UGT85C2, UGT76G1 and UGT91D2 polypeptides. In another embodiment, the recombinant microorganism comprises the exogenous nucleic acids encoding UGT85C2, UGT76G1, UGT74G1, and UGT91D2 polypeptides. In yet another embodiments, the recombinant microorganism comprises the exogenous nucleic acids encoding UGT85C2, UGT76G1, UGT74G1, and EUGT11 polypeptides. In yet another embodiment, the recombinant microorganism comprises the exogenous nucleic acids encoding UGT85C2, UGT76G1, UGT74G1, UGT91D2 (including inter alia 91D2e, 91D2m, 91D2e-b and functional homologs thereof) and EUGT11 polypeptides.

In another aspect, this document relates to a method of producing a Rebaudioside, comprising: culturing the recombinant microorganism described herein in a culture medium, under conditions in which the genes encoding a GGPPS; an ent-copalyl diphosphate synthase (CDPS) polypeptide; a kaurene oxidase (KO) polypeptide; a kaurene synthase (KS) polypeptide; a steviol synthase (KAH) polypeptide; a cytochrome P450 reductase (CPR) polypeptide; a UGT85C2 polypeptide; a UGT74G1 polypeptide; a UGT76G1 polypeptide; a UGT91D2 polypeptide; or a EUGT11 polypeptide are expressed, comprising inducing expression of said genes or constitutively expressing said genes; synthesizing one or more of a compound, comprising the Rebaudioside in the recombinant microorganism; and isolating one or more of the compounds comprising the Rebaudioside. In one embodiment, the Rebaudioside is Rebaudioside A, Rebaudioside B, Rebaudioside D, Rebaudioside E, or Rebaudioside M. In another embodiment, the recombinant microorganism overexpresses YOR1, SNQ2, PDR1 or FLR1.

In one embodiment, the recombinant microorganism is a microorganism described herein is selected from, but not limited to, a genus from *Agaricus, Aspergillus, Bacillus, Candida, Corynebacterium, Escherichia, Fusarium/Gibberella, Kluyveromyces, Laetiporus, Lentinus, Phaffia, Phanerochaete, Pichia, Physcomitrella, Rhodoturula, Saccharomyces, Schizosaccharomyces, Sphaceloma, Xanthophyllomyces* and *Yarrowia*. In another embodiment, the recombinant microorganism is a yeast cell from *Saccharomyces cerevisiae, Schizosaccharomyces pombe, Yarrowia lipolytica, Candida glabrata, Ashbya gossypii, Cyberlindnera jadinii, Pichia pastoris, Kluyveromyces lactis, Hansenula polymorphs, Candida boidinii, Arxula adeninivorans, Xanthophyllomyces dendrorhous* or *Candida albicans* species.

In yet another aspect, this document relates to a method of affecting excretion of steviol glycosides, comprising: using the methods described herein to produce a steviol glycoside, wherein at least one recombinant gene is expressed, and culturing the recombinant microorganism in a medium under conditions in which the steviol glycoside is synthesized; and expressing at least one gene that is a transporter gene, a transcription factor gene that regulates expression of at least one transporter gene, or both, and isolating the steviol glycoside produced during the culturing step.

I. Steviol and Steviol Glycoside Biosynthesis Polypeptides
A. Steviol Biosynthesis Polypeptides In addition to expressing heterologous transporter and/or transcription factor genes, or modifying expression of endogenous transporter genes as described above, a host described herein contains and expresses gene products involved in the conversion of isoprenoid precursors to steviol.

The biochemical pathway to produce steviol involves formation of geranylgeranyl diphosphate, cyclization to (−)-copalyl diphosphate, followed by oxidation and hydroxylation to form steviol. Thus, conversion of geranylgeranyl diphosphate to steviol in a recombinant microorganism involves the expression of a gene encoding a kaurene synthase (KS), a gene encoding a kaurene oxidase (KO), and a gene encoding a steviol synthetase (KAH). Steviol synthetase also is known as kaurenoic acid 13-hydroxylase.

Suitable KS polypeptides are known. For example, suitable KS enzymes include those made by *Stevia rebaudiana, Zea mays, Populus trichocarpa*, and *Arabidopsis thaliana*. See, Table 2 and PCT Application Nos. PCT/US2012/050021 and PCT/US2011/038967, which are incorporated herein by reference in their entirety.

TABLE 2

Kuarene Synthase (KS) Clones

| Enzyme Source Organism | gi Number | Accession Number | Construct Name | Length (nts) |
|---|---|---|---|---|
| Stevia rebaudiana | 4959241 | AAD34295 (SEQ ID NO: 1) | MM-12 | 2355 |
| Stevia rebaudiana | 4959239 | AAD34294 (SEQ ID NO: 2) | MM-13 | 2355 |
| Zea mays | 162458963 | NP_001105097 (SEQ ID NO: 3) | MM-14 | 1773 |
| Populus trichocarpa | 224098838 | XP_002311286 (SEQ ID NO: 4) | MM-15 | 2232 |
| Arabidopsis thaliana | 3056724 | AF034774 (SEQ ID NO: 5) AAC39443 (SEQ ID NO: 6) | EV-70 | 2358 |

Suitable KO polypeptides are known. For example, suitable KO enzymes include those made by *Stevia rebaudiana, Arabidopsis thaliana, Gibberella fujikoroi* and *Trametes versicolor*. See, Table 3 and PCT Application Nos. PCT/US2012/050021 and PCT/US2011/038967, which are incorporated herein by reference in their entirety.

TABLE 3

Kaurene Oxidase (KO Clones)

| Enzyme Source Organism | gi Number | Accession Number | Construct Name | Length (nts) |
|---|---|---|---|---|
| Stevia rebaudiana | 76446107 | ABA42921 (SEQ ID NO: 7) | MM-18 | 1542 |
| Arabidopsis thaliana | 3342249 | AAC39505 (SEQ ID NO: 8) | MM-19 | 1530 |
| Gibberella fujikoroi | 4127832 | CAA76703 (SEQ ID NO: 9) | MM-20 | 1578 |
| Trametes versicolor | 14278967 | BAB59027 (SEQ ID NO: 10) | MM-21 | 1500 |

Suitable KAH polypeptides are known. For example, suitable KAH enzymes include those made by *Stevia rebaudiana, Arabidopsis thaliana, Vitis vinifera* and *Medicago trunculata*. See, e.g., Table 4, PCT Application Nos. PCT/US2012/050021 and PCT/US2011/038967, U.S. Patent Publication Nos. 2008/0271205 and 2008/0064063, and Genbank Accession No. gi 189098312 (SEQ ID NO: 11) and GenBank Accession ABD60225; GI:89242710 (SEQ ID NO: 12), which are incorporated herein by reference in their entirety. The steviol synthetase from *Arabidopsis thaliana* is classified as a CYP714A2.

TABLE 4

Steviol synthase (KAH) Clones

| Enzyme Source Organism | gi Number | Accession Number | Plasmid Name | Construct Name | Length (nts) |
|---|---|---|---|---|---|
| Stevia rebaudiana | —* | (SEQ ID NO: 13) | pMUS35 | MM-22 | 1578 |
| Stevia rebaudiana | 189418962 | ACD93722 (SEQ ID NO: 14) | pMUS36 | MM-23 | 1431 |

TABLE 4-continued

Steviol synthase (KAH) Clones

| Enzyme Source Organism | gi Number | Accession Number | Plasmid Name | Construct Name | Length (nts) |
|---|---|---|---|---|---|
| *Arabidopsis thaliana* | 15238644 | NP_197872 (SEQ ID NO: 15) | pMUS37 | MM-24 | 1578 |
| *Vitis vinifera* | 225458454 | XP_002282091 (SEQ ID NO: 16) | pMUS38 | MM-25 | 1590 |
| *Medicago trunculata* | 84514135 | ABC59076 (SEQ ID NO: 17) | pMUS39 | MM-26 | 1440 |

*= Sequence is identified with sequence identifier number 2 as shown in U.S. Patent Publication No. 2008-0064063.

In addition, a KAH polypeptide from *Stevia rebaudiana* that was identified as described in PCT Application No. PCT/US2012/050021 is particularly useful in a recombinant host. Nucleotide sequences encoding *S. rebaudiana* KAH (SrKAHe1; SEQ ID NO: 18) and *S. rebaudiana* KAH that has been codon-optimized for expression in yeast are set forth in the same PCT application, as is the encoded amino acid sequence of the *S. rebaudiana* KAH (SEQ ID NO: 19). The *S. rebaudiana* KAH shows significantly higher steviol synthase activity as compared to the *Arabidopsis thaliana* ent-kaurenoic acid hydroxylase described by Yamaguchi et al. (U.S. Patent Publication No. 2008/0271205 A1) when expressed in *S. cerevisiae*. The *S. rebaudiana* KAH polypeptide has less than 20% identity to the KAH from U.S. Patent Publication No. 2008/0271205, and less than 35% identity to the KAH from U.S. Patent Publication No. 2008/0064063.

In some embodiments, a recombinant microorganism contains a recombinant gene encoding a KO and/or a KAH polypeptide. Such microorganisms also typically contain a recombinant gene encoding a cytochrome P450 reductase (CPR) polypeptide, since certain combinations of KO and/or KAH polypeptides require expression of an exogenous CPR polypeptide. In particular, the activity of a KO and/or a KAH polypeptide of transporter origin can be significantly increased by the inclusion of a recombinant gene encoding an exogenous CPR polypeptide. Suitable CPR polypeptides are known. For example, suitable CPR enzymes include those made by *Stevia rebaudiana* and *Arabidopsis thaliana*. See, e.g., Table 5 and PCT Application Nos. PCT/US2012/050021 and PCT/US2011/038967, which are incorporated herein by reference in their entirety.

TABLE 5

Cytochrome P450 Reductase (CPR) Clones

| Enzyme Source Organism | gi Number | Accession Number | Plasmid Name | Construct Name | Length (nts) |
|---|---|---|---|---|---|
| *Stevia rebaudiana* | 93211213 | ABB88839 (SEQ ID NO: 20) | pMUS40 | MM-27 | 2133 |
| *Arabidopsis thaliana* | 15233853 | NP_194183 (SEQ ID NO: 21) | pMUS41 | MM-28 | 2079 |
| *Giberella fujikuroi* | 32562989 | CAE09055 (SEQ ID NO: 22) | pMUS42 | MM-29 | 2142 |

For example, the steviol synthase encoded by *Stevia rebaudiana* KAHe1 is activated by the *S. cerevisiae* CPR encoded by gene NCP1 (YHR042W). Even better activation of the steviol synthase encoded by SrKAHe1 is observed when the *Arabidopsis thaliana* CPR encoded by the gene ATR2 (SEQ ID NO: 99) or the *S. rebaudiana* CPR encoded by the genes CPR7 (SEQ ID NO: 23) or CPR8 (SEQ ID NO: 24) are co-expressed. Amino acid sequence of the *A. thaliana* polypeptides ATR1 (SEQ ID NO: 25) and ATR2 (SEQ ID NO: 26) and *S. rebaudiana* CPR7 (SEQ ID NO: 27) and CPR8 (SEQ ID NO: 28) polypeptides are shown in PCT Application No. PCT/US2012/050021.

Expression in a recombinant microorganism of these genes results in the conversion of geranylgeranyl diphosphate to steviol.

B. Steviol Glycoside Biosynthesis Polypeptides

In addition to the transport mutations described above, a host cell as described herein can convert steviol to a steviol glycoside. Such a host (e.g., microorganism) contains genes encoding one or more UDP Glycosyl Transferases, also known as UGTs. UGTs transfer amonosaccharide unit from an activated nucleotide sugar to an acceptor moiety, in this case, an —OH or —COOH moiety on steviol, the glucose moiety on a steviol glycoside, or steviol derivatives. UGTs have been classified into families and subfamilies based on sequence homology. Li et al. J. Biol. Chem. 276:4338-4343 (2001).

B.1 Rubusoside Biosynthesis Polypeptides

The biosynthesis of rubusoside involves glycosylation of the 13-OH and the 19-COOH of steviol. See FIG. 1. Conversion of steviol to rubusoside in a recombinant host such as a microorganism can be accomplished by the expression of gene(s) encoding UGTs 85C2 and 74G1, which transfer a glucose unit to the 13-OH or the 19-COOH, respectively, of steviol.

A suitable UGT85C2 functions as a uridine 5'-diphospho glucosyl:steviol 13-OH transferase, and a uridine 5'-diphospho glucosyl:steviol-19-O-glucoside 13-OH transferase. Functional UGT85C2 polypeptides also may catalyze glucosyl transferase reactions that utilize steviol glycoside substrates other than steviol and steviol-19-O-glucoside.

A suitable UGT74G1 polypeptide functions as a uridine 5'-diphospho glucosyl:steviol 19-COOH transferase and a uridine 5'-diphospho glucosyl:steviol-13-O-glucoside 19-COOH transferase. Functional UGT74G1 polypeptides also may catalyze glycosyl transferase reactions that utilize steviol glycoside substrates other than steviol and steviol-13-O-glucoside, or that transfer sugar moieties from donors other than uridine diphosphate glucose.

A recombinant microorganism expressing a functional UGT74G1 and a functional UGT85C2 can make rubusoside and both steviol monosides (i.e., steviol 13-O-monoglucoside and steviol 19-O-monoglucoside) when steviol is used as a feedstock in the medium. One or more of such genes may be present naturally in the host. Typically, however, such genes are recombinant genes that have been transformed into a host (e.g., microorganism) that does not naturally possess them.

As used herein, the term recombinant host is intended to refer to a host, the genome of which has been augmented by at least one incorporated DNA sequence. Such DNA sequences include but are not limited to genes that are not naturally present, DNA sequences that are not normally transcribed into RNA or translated into a protein ("expressed"), and other genes or DNA sequences which one desires to introduce into the non-recombinant host. It will be appreciated that typically the genome of a recombinant host described herein is augmented through the stable introduction of one or more recombinant genes. Generally, the introduced DNA is not originally resident in the host that is the recipient of the DNA, but it is within the scope of the invention to isolate a DNA segment from a given host, and to subsequently introduce one or more additional copies of that DNA into the same host, e.g., to enhance production of the product of a gene or alter the expression pattern of a gene. In some instances, the introduced DNA will modify or even replace an endogenous gene or DNA sequence by, e.g., homologous recombination or site-directed mutagenesis. Suitable recombinant hosts include microorganisms.

The term "recombinant gene" refers to a gene or DNA sequence that is introduced into a recipient host, regardless of whether the same or a similar gene or DNA sequence may already be present in such a host. "Introduced," or "augmented" in this context, is known in the art to mean introduced or augmented by the hand of man. Thus, a recombinant gene may be a DNA sequence from another species, or may be a DNA sequence that originated from or is present in the same species, but has been incorporated into a host by recombinant methods to form a recombinant host. It will be appreciated that a recombinant gene that is introduced into a host can be identical to a DNA sequence that is normally present in the host being transformed, and is introduced to provide one or more additional copies of the DNA to thereby permit overexpression or modified expression of the gene product of that DNA.

Suitable UGT74G1 and UGT85C2 polypeptides include those made by *Stevia rebaudiana*. Genes encoding functional UGT74G1 and UGT85C2 polypeptides from *Stevia* are reported in Richman et al. Plant J. 41: 56-67 (2005). Amino acid sequences of *S. rebaudiana* UGT74G1 (SEQ ID NO: 29) and UGT85C2 (SEQ ID NO: 30) polypeptides are set forth in as sequence identifiers numbers 1 and 3, respectively, of PCT Application No. PCT/US2012/050021). Nucleotide sequences that encode UGT74G1 (SEQ ID NO: 100) and UGT85C2, (SEQ ID NO: 31) as well as UGT sequences that have been optimized for expression in yeast, for example UGTs 85C2 (SEQ ID NO: 32), 91D2e, 91D2e-b, EUGT11 and 76G1, are provided. See also the UGT85C2 and UGT74G1 variants described below in the "Functional Homolog" section. For example, a UGT85C2 polypeptide can contain substitutions at positions 65, 71, 270, 289, and 389 can be used (e.g., A65S, E71Q, T270M, Q289H, and A389V).

In some embodiments, the recombinant host is a microorganism. The recombinant microorganism can be grown on media containing steviol in order to produce rubusoside. In other embodiments, however, the recombinant microorganism expresses one or more recombinant genes involved in steviol biosynthesis, e.g., a CDPS gene, a KS gene, a KO gene and/or a KAH gene. Suitable CDPS polypeptides are known.

For example, suitable CDPS enzymes include those made by *Stevia rebaudiana*, *Streptomyces clavuligerus*, *Bradyrhizobium japonicum*, *Zea mays*, and *Arabidopsis*. See, e.g., Table 6 and PCT Application Nos. PCT/US2012/050021 and PCT/US2011/038967, which are incorporated herein by reference in their entirety.

In some embodiments, CDPS polypeptides that lack a chloroplast transit peptide at the amino terminus of the unmodified polypeptide can be used. For example, the first 150 nucleotides from the 5' end of the *Zea mays* CDPS coding sequence shown in FIG. 14 of PCT Publication No. PCT/US2012/050021 can be removed. Doing so removes the amino terminal 50 residues of the amino acid sequence, which encode a chloroplast transit peptide. The truncated CDPS gene can be fitted with a new ATG translation start site and operably linked to a promoter, typically a constitutive or highly expressing promoter. When a plurality of copies of the truncated coding sequence are introduced into a microorganism, expression of the CDPS polypeptide from the promoter results in an increased carbon flux towards ent-kaurene biosynthesis.

TABLE 6

| CDPS Clones | | | | | |
|---|---|---|---|---|---|
| Enzyme Source Organism | gi Number | Accession Number | Plasmid Name | Construct Name | Length (nts) |
| *Stevia rebaudiana* | 2642661 | AAB87091 (SEQ ID NO: 33) | pMUS22 | MM-9 | 2364 |
| *Streptomyces clavuligerus* | 197705855 | EDY51667 (SEQ ID NO: 34) | pMUS23 | MM-10 | 1584 |
| *Bradyrhizobium japonicum* | 529968 | AAC28895.1 (SEQ ID NO: 35) | pMUS24 | MM-11 | 1551 |
| *Zea mays* | 50082774 | AY562490 (SEQ ID NO: 36) | | EV65 | 2484 |
| | 50082775 | AAT70083 (SEQ ID NO: 37) | | | |

TABLE 6-continued

CDPS Clones

| Enzyme Source Organism | gi Number | Accession Number | Plasmid Name | Construct Name | Length (nts) |
|---|---|---|---|---|---|
| Arabidopsis thaliana | 18412041 | NM_116512 (SEQ ID NO: 38) | | EV64 | 2409 |
| | 15235504 | NP_192187 (SEQ ID NO: 39) | | | |

CDPS-KS bifunctional proteins also can be used. Nucleotide sequences encoding the CDPS-KS bifunctional enzymes shown in Table 7 were modified for expression in yeast (see PCT Application Nos. PCT/US2012/050021). A bifunctional enzyme from *Gibberella fujikuroi* also can be used.

TABLE 7

CDPS-KS Clones

| Enzyme Source Organism | gi Number | Accession Number | Construct Name | Length (bp) |
|---|---|---|---|---|
| Phomopsis amygdali | 186704306 | BAG30962 (SEQ ID NO: 40) | MM-16 | 2952 |
| Physcomitrella patens | 146325986 | BAF61135 (SEQ ID NO: 41) | MM-17 | 2646 |
| Gibberella fujikuroi | 62900107 | Q9UVY5.1 (SEQ ID NO: 42) | | 2859 |

Thus, a microorganism containing a CDPS gene, a KS gene, a KO gene and a KAH gene in addition to a UGT74G1 and a UGT85C2 gene is capable of producing both steviol monosides and rubusoside without the necessity for using steviol as a feedstock.

In some embodiments, the recombinant microorganism further expresses a recombinant gene encoding a geranylgeranyl diphosphate synthase (GGPPS). Suitable GGPPS polypeptides are known. For example, suitable GGPPS enzymes include those made by *Stevia rebaudiana*, *Gibberella fujikuroi*, *Mus musculus*, *Thalassiosira pseudonana*, *Streptomyces clavuligerus*, *Sulfulobus acidocaldarius*, *Synechococcus* sp. and *Arabidopsis thaliana*. See, Table 8 and PCT Application Nos. PCT/US2012/050021 and PCT/US2011/038967, which are incorporated herein by reference in their entirety.

In some embodiments, the recombinant microorganism further can express recombinant genes involved in diterpene biosynthesis or production of terpenoid precursors, e.g., genes in the methylerythritol 4-phosphate (MEP) pathway or genes in the mevalonate (MEV) pathway discussed below, have reduced phosphatase activity, and/or express a sucrose synthase (SUS) as discussed herein. In other embodiments, endogenous genes (e.g. DPP1) may be inactivated or deleted in order to affect availability of some GGPP/FPP precursors.

B.2 Rebaudioside A, Rebaudioside B, Rebaudioside D, Rebaudioside E, and Rebaudioside M Biosynthesis Polypeptides Biosynthesis of rebaudioside A involves glucosylation of the aglycone steviol. Specifically, rebaudioside A can be formed by glucosylation of the 13-OH of steviol which forms the 13-O-steviolmonoside, glucosylation of the C-2' of the 13-O-glucose of steviolmonoside which forms steviol-1,2-bioside, glucosylation of the C-19 carboxyl of steviol-1,2-bioside which forms stevioside, and glucosylation of the C-3' of the C-13-O-glucose of stevioside. The order in which each glucosylation reaction occurs can vary. See FIG. 1.

Biosynthesis of rebaudioside B involves glucosylation of the aglycone steviol. Specifically, rebaudioside B can be formed by glucosylation of the 13-OH of steviol which forms the 13-O-steviolmonoside, glucosylation of the C-2' of the 13-O-glucose of steviolmonoside which forms steviol-1,2-bioside, and glucosylation of the C-3' of the C-13-O-glucose of steviol-1,2-bioside. The order in which each glucosylation reaction occurs can vary.

Biosynthesis of rebaudioside E and/or rebaudioside D involves glucosylation of the aglycone steviol. Specifically,

TABLE 8

GGPPS Clones

| Enzyme Source Organism | gi Number | Accession Number | Plasmid Name | Construct Name | Length (nts) |
|---|---|---|---|---|---|
| Stevia rebaudiana | 90289577 | ABD92926 (SEQ ID NO: 43) | pMUS14 | MM-1 | 1086 |
| Gibberella fujikuroi | 3549881 | CAA75568 (SEQ ID NO: 44) | pMUS15 | MM-2 | 1029 |
| Mus musculus | 47124116 | AAH69913 (SEQ ID NO: 45) | pMUS16 | MM-3 | 903 |
| Thalassiosira pseudonana | 223997332 | XP_002288339 (SEQ ID NO: 46) | pMUS17 | MM-4 | 1020 |
| Streptomyces clavuligerus | 254389342 | ZP_05004570 (SEQ ID NO: 47) | pMUS18 | MM-5 | 1068 |
| Sulfulobus acidocaldarius | 506371 | BAA43200 (SEQ ID NO: 47) | pMUS19 | MM-6 | 993 |
| Synechococcus sp. | 86553638 | ABC98596 (SEQ ID NO: 49) | pMUS20 | MM-7 | 894 |
| Arabidopsis thaliana | 15234534 | NP_195399 (SEQ ID NO: 50) | pMUS21 | MM-8 | 1113 | rebaudioside E can be formed by glucosylation of the 13-OH of steviol which forms steviol-13-O-glucoside, glucosylation of the C-2' of the 13-O-glucose of steviol-13-O-glucoside which forms the steviol-1,2-bioside, glucosylation of the C-19 carboxyl of the 1,2-bioside to form 1,2-stevioside, and glucosylation of the C-2' of the 19-O-glucose of the 1,2-stevioside to form rebaudioside E. Rebaudioside D can be formed by glucosylation of the C-3' of the C-13-O-glucose of rebaudioside E. The order in which each glycosylation reaction occurs can vary. For example, the glucosylation of the C-2' of the 19-O-glucose may be the last step in the pathway, wherein Rebaudioside A is an intermediate in the pathway. See FIG. 1.

It has been discovered that conversion of steviol to rebaudioside A, rebaudioside B rebaudioside D, rebaudioside M, and/or rebaudioside E in a recombinant host can be accomplished by expressing the following functional UGTs: EUGT11, 91D2, 74G1, 85C2, and 76G1. Thus, a recombinant microorganism expressing combinations of these UGTs can make rebaudioside A and rebaudioside D when steviol is used as a feedstock. Typically, one or more of these genes are recombinant genes that have been transformed into a microorganism that does not naturally possess them. It has also been discovered that UGTs designated herein as SM12UGT can be substituted for UGT91D2.

In some embodiments, less than five (e.g., one, two, three, or four) UGTs are expressed in a host. For example, a recombinant microorganism expressing a functional EUGT11 can make rebaudioside D when rebaudioside A is used as a feedstock. A recombinant microorganism expressing, UGTs 85C, 91D2e or EUGT11, but preferably 91D2e, and 76G1 can make rebaudioside B. A recombinant microorganism expressing EUGT11, 76G1, and 91D12 (e.g., 91D2e), can make rebaudioside D when rubusoside or 1,2-stevioside is used as a feedstock. As another alternative, a recombinant microorganism expressing three functional UGTs, EUGT11, 74G1, 76G1, and optionally 91D2, can make rebaudioside D when fed the monoside, steviol-13-O-glucoside, in the medium. Similarly, conversion of steviol-19-O-glucoside to rebaudioside D in a recombinant microorganism can be accomplished by the expression of genes encoding UGTs EUGT11, 85C2, 76G1, and 91D2 (e.g., 91D2e) when fed steviol-19-O-glucoside. Typically, one or more of these genes are recombinant genes that have been transformed into a host that does not naturally possess them.

Rebaudioside M Polypeptides

Conversion of steviol to Rebaudioside M in a recombinant host can be accomplished by expressing combinations of the following functional UGTs: 91D2, EUGT11, 74G1, 85C2, and 76G1. See FIG. 1. It is particularly useful to express EUGT11 at high levels using a high copy number plasmid, or using a strong promoter, or multiple integrated copies of the gene, or episome under selection for high copy number of the gene. Thus, a recombinant microorganism expressing combinations of these UGTs can make Rebaudioside A (85C2; 76G1; 74G1; 91D2e), Rebaudioside D (85C2; 76G1; 74G1; 91D2e; EUGT11), Rebaudioside E (85C2; 74G1; 91D2e; EUGT11), or Rebaudioside M (85C2; 76G1; 74G1; 91D2e; EUGT11). See FIG. 1. Typically, one or more of these genes are recombinant genes that have been transformed into a microorganism that does not naturally possess them. It has also been discovered that UGTs designated herein as SM12UGT can be substituted for UGT91D2.

Targeted production of individual Rebaudiosides, as shown in FIG. 1, is accomplished by controlling the relative levels of UDP-glycosyl transferase activities. This can be accomplished by differential copy numbers of the UGT-encoding genes, differential promoter strengths, and/or by utilizing mutants with increased specificity/activity towards the product of interest. See FIG. 1. For example, low levels of Rebaudioside D, E, and M will be formed if EUGT11 is expressed at low levels in comparison to the other UGTs, which would favor Rebaudioside A formation. High levels of EUGT11 expression result in more of the 19-O 1,2 diglucoside substrate for the UGT76G1 to react with in order to form Rebaudioside M. Since this is not the preferred activity of the UGT76G1 polypeptide, additional copies or mutant versions of the UGT76G1 can improve the rate of Rebaudioside M formation from Rebaudioside D. A suitable UGT76G1 also catalyzes the transfer of a glucose moiety to the C-3' of the 19-O glucose of the acceptor molecule wherein the acceptor molecule can contain a 1,2 glycoside moiety at the 19-0 position of steviol.

Suitable UGT74G1 and UGT85C2 polypeptides include those discussed above. A suitable UGT76G1 adds a glucose moiety to the C-3' of the C-13-O-glucose of the acceptor molecule, a steviol 1,2 glycoside. Thus, UGT76G1 functions, for example, as a uridine 5'-diphospho glucosyl: steviol 13-O-1,2 glucoside C-3' glucosyl transferase and a uridine 5'-diphospho glucosyl:steviol-19-O-glucose, 13-O-1,2 bioside C-3' glucosyl transferase. Functional UGT76G1 polypeptides may also catalyze glucosyl transferase reactions that utilize steviol glycoside substrates that contain sugars other than glucose. Suitable UGT76G1 polypeptides include those made by S. rebaudiana and reported in Richman et al. Plant J. 41: 56-67 (2005). The amino acid sequence of a S. rebaudiana UGT76G1 polypeptide (e.g. SEQ ID NO: 85) is set forth in PCT Publication No. PCT/US2012/050021, as is a nucleotide sequence that encodes the UGT76G1 polypeptide and is optimized for expression in yeast. See also the UGT76G1 variants set forth in the "Functional Homolog" section.

A suitable EUGT11 or UGT91D2 polypeptide functions as a uridine 5'-diphospho glucosyl:steviol-13-O-glucoside transferase (also referred to as a steviol-13-monoglucoside 1,2-glucosylase), transferring a glucose moiety to the C-2' of the 13-O-glucose of the acceptor molecule, steviol-13-O-glucoside.

A suitable EUGT11 or UGT91D2 polypeptide also functions as a uridine 5'-diphospho glucosyl: rubusoside transferase transferring a glucose moiety to the C-2' of the 13-O-glucose of the acceptor molecule, rubusoside, to produce stevioside. EUGT11 polypeptides also can efficiently transfer a glucose moiety to the C-2' of the 19-O-glucose of the acceptor molecule, rubusoside, to produce a 19-O-1,2-diglycosylated rubusoside. EUGT11 is particularly efficient at transfer of glucose molecules to 19-O-glucose substituted steviol glycoside molecules.

Functional EUGT11 or UGT91D2 polypeptides also can catalyze reactions that utilize steviol glycoside substrates other than steviol-13-O-glucoside and rubusoside. For example, a functional EUGT11 polypeptide may efficiently utilize stevioside as a substrate, transferring a glucose moiety to the C-2' of the 19-O-glucose residue to produce Rebaudioside E. Functional EUGT11 and UGT91D2 polypeptides may also utilize Rebaudioside A as a substrate, transferring a glucose moiety to the C-2' of the 19-O-glucose residue of Rebaudioside A to produce Rebaudioside D. EUGT11 (SEQ ID NO: 51) can convert Rebaudioside A to Rebaudioside D at a rate that is least 20 times faster (e.g., as least 25 times or at least 30 times faster) than the corresponding rate of UGT91D2e (SEQ ID NO: 54) when the reactions are performed under similar conditions, i.e., similar time, temperature, purity, and substrate concentration. As such, EUGT11 produces greater amounts of RebD than UGT91D2e when incubated under similar conditions.

In addition, a functional EUGT11 exhibits significant C-2' 19-O-diglycosylation activity with rubusoside or stevioside as substrates, whereas UGT91D2e has less diglycosylation activity with these substrates. Thus, a functional EUGT11 can be distinguished from UGT91D2e by the differences in steviol glycoside substrate-specificity.

A functional EUGT11 or UGT91D2 polypeptide typically does not transfer a glucose moiety to steviol compounds having a 1,3-bound glucose at the C-13 position, i.e., transfer of a glucose moiety to steviol 1,3-bioside and 1,3-stevioside does not occur at detectable levels under most conditions.

Suitable EUGT11 polypeptides can include the EUGT11 polypeptide from *Oryza sativa* (GenBank Accession No. AC133334; SEQ ID NO: 51). For example, an EUGT11 polypeptide can have an amino acid sequence with at least 70% sequence identity (e.g., at least 75, 80, 85, 90, 95, 96, 97, 98, or 99% sequence identity) to the amino acid sequence set forth in SEQ ID NO: 51. The nucleotide sequence encoding the amino acid sequence of EUGT11 also is set forth in SEQ ID NO: 52 as is a codon optimized nucleotide sequence for expression in yeast SEQ ID NO: 53.

Suitable functional UGT91D2 polypeptides include the polypeptides designated UGT91D2e and UGT91D2m. The amino acid sequence of an exemplary UGT91D2e polypeptide from *Stevia rebaudiana* is set forth in SEQ ID NO: 54 (encoded by nucleotide sequence identifier number 5 of PCT Application No. PCT/US2012/050021), which also discloses the *S. rebaudiana* nucleotide sequence encoding the polypeptide, a nucleotide sequence that encodes the polypeptide and that has been codon optimized (SEQ ID NO: 158) for expression in yeast, the amino acid sequences of exemplary UGT91D2m polypeptides from *S. rebaudiana*, and nucleic acid sequences encoding the exemplary UGT91D2m polypeptides. The amino acid sequence of exemplary UGT91D2m is shown as SEQ ID NO: 55. UGT91D2 variants containing a substitution at amino acid residues 206, 207, and 343 also can be used. For example, the amino acid sequence having G206R, Y207C, and W343R mutations with respect to wild-type UGT92D2e can be used. In addition, a UGT91D2 variant containing substitutions at amino acid residues 211 and 286 can be used. For example, a UGT91D2 variant can include a substitution of a methionine for leucine at position 211 and a substitution of an alanine for valine at position 286. See also the UGT91D2 variants descried in the "functional homolog" section.

As indicated above, UGTs designated herein as SM12UGT can be substituted for UGT91D2. Suitable functional SM12UGT polypeptides include those made by *Ipomoea purpurea* (Japanese morning glory) and described in Morita et al. Plant J. 42: 353-363 (2005). The amino acid sequence encoding the *I. purpurea* IP3GGT polypeptide (SEQ ID NO: 56) is set forth using sequence identifier number 76 in PCT Application No. PCT/US2012/050021, as is a nucleotide sequence (SEQ ID NO: 57) that encodes the polypeptide and that has been codon optimized for expression in yeast. Another suitable SM12UGT polypeptide is a Bp94B1 polypeptide having an R25S mutation. See Osmani et al. Plant Phys. 148: 1295-1308 (2008) and Sawada et al. J. Biol. Chem. 280: 899-906 (2005). The amino acid sequence of the *Bellis perennis* (red daisy) UGT94B1 polypeptide (SEQ ID NO: 58) is set forth using sequence identifier number 78 in PCT Application No. PCT/US2012/050021, as is a nucleotide sequence (SEQ ID NO: 59) that encodes the polypeptide and that has been codon optimized for expression in yeast.

In some embodiments, the recombinant microorganism is grown on media containing steviol-13-O-glucoside or steviol-19-O-glucoside in order to produce rebaudioside A, rebaudioside B, rebaudioside D, rebaudioside E and/or rebaudioside M. In such embodiments, the microorganism contains and expresses genes encoding a functional EUGT11, a functional UGT74G1, a functional UGT85C2, a functional UGT76G1, and a functional UGT91D2, and is capable of accumulating rebaudioside A, rebaudioside B, rebaudioside D, rebaudioside E and/or rebaudioside M when steviol, one or both of the steviolmonosides, or rubusoside is used as feedstock.

In other embodiments, the recombinant microorganism is grown on media containing rubusoside in order to produce rebaudioside A, rebaudioside B, rebaudioside D, rebaudioside E and/or rebaudioside M. In such embodiments, the microorganism contains and expresses genes encoding a functional EUGT11, a functional UGT76G1, and a functional UGT91D2, and is capable of producing rebaudioside A, rebaudioside B, rebaudioside D, rebaudioside E and/or rebaudioside M when rubusoside is used as feedstock.

In other embodiments the recombinant microorganism expresses one or more genes involved in steviol biosynthesis, e.g., a CDPS gene, a KS gene, a KO gene and/or a KAH gene. Thus, for example, a microorganism containing a CDPS gene, a KS gene, a KO gene and a KAH gene, in addition to a EUGT11, a UGT74G1, a UGT85C2, a UGT76G1, and optionally a functional UGT91D2 (e.g., UGT91D2e), is capable of producing rebaudioside A, rebaudioside B, rebaudioside D, rebaudioside E and/or rebaudioside M without the necessity for including steviol in the culture media. In another example, a microorganism containing a CDPS gene, a KS gene, a KO gene and a KAH gene, in addition to a UGT74G1, a UGT85C2, a UGT76G1, and optionally a functional UGT91D2 (e.g., UGT91D2e), is capable of producing rebaudio side A without the necessity for including steviol in the culture media. In yet another example, a microorganism containing a CDPS gene, a KS gene, a KO gene and a KAH gene, in addition to a UGT85C2, a UGT76G1, and optionally a functional UGT91D2 (e.g., UGT91D2e), is capable of producing rebaudioside B without the necessity for including steviol in the culture media.

In some embodiments, the recombinant host further contains and expresses a recombinant GGPPS gene in order to provide increased levels of the diterpene precursor geranylgeranyl diphosphate, for increased flux through the steviol biosynthetic pathway.

In some embodiments, the recombinant host further contains a construct to silence the expression of non-steviol pathways consuming geranylgeranyl diphosphate, ent-Kaurenoic acid or farnesyl pyrophosphate, thereby providing increased flux through the steviol and steviol glycosides biosynthetic pathways. For example, flux to sterol production pathways such as ergosterol may be reduced by downregulation of the ERG9 gene. See section C.4 below. In cells that produce gibberellins, gibberellin synthesis may be downregulated to increase flux of ent-kaurenoic acid to steviol. In carotenoid-producing organisms, flux to steviol may be increased by downregulation of one or more carotenoid biosynthetic genes. In some embodiments, the recombinant microorganism further can express recombinant genes involved in diterpene biosynthesis or production of terpenoid precursors, e.g., genes in the MEP or MEV) pathways, have reduced phosphatase activity, and/or express a SUS.

One with skill in the art will recognize that by modulating relative expression levels of different UGT genes, a recombinant host can be tailored to specifically produce steviol glycoside products in a desired proportion. Transcriptional regulation of steviol biosynthesis genes and steviol glycoside biosynthesis genes can be achieved by a combination of transcriptional activation and repression using techniques known to those in the art. For in vitro reactions, one with skill in the art will recognize that addition of different levels of UGT enzymes in combination or under conditions which impact the relative activities of the different UGTS in combination will direct synthesis towards a desired proportion of each steviol glycoside. One with skill in the art will recognize that a higher proportion of rebaudioside D or E or more efficient conversion to rebaudioside D or E can be obtained with a diglycosylation enzyme that has a higher activity for the 19-O-glucoside reaction as compared to the 13-O-glucoside reaction (substrates rebaudioside A and stevioside).

In some embodiments, a recombinant host such as a microorganism produces rebaudioside D-enriched steviol glycoside compositions that have greater than at least 3% rebaudioside D by weight total steviol glycosides, e.g., at least 4% rebaudioside D at least 5% rebaudioside D, 10-20% rebaudioside D, 20-30% rebaudioside D, 30-40% rebaudioside D, 40-50% rebaudioside D, 50-60% rebaudioside D, 60-70% rebaudioside D, 70-80% rebaudioside D.

In some embodiments, a recombinant host such as a microorganism produces steviol glycoside compositions that have at least 90% rebaudioside D, e.g., 90-99% rebaudioside D. Other steviol glycosides present may include steviol monosides, steviol glucobiosides, rebaudioside A, rebaudioside E, and stevioside. In some embodiments, the rebaudioside D-enriched composition produced by the host (e.g., microorganism) can be further purified and the rebaudioside D or rebaudioside E so purified can then be mixed with other steviol glycosides, flavors, or sweeteners to obtain a desired flavor system or sweetening composition. For instance, a rebaudioside D-enriched composition produced by a recombinant host can be combined with a rebaudio side A or F-enriched composition produced by a different recombinant host, with rebaudioside A or F purified from a Stevia extract, or with rebaudioside A or F produced in vitro.

In some embodiments, rebaudioside A, rebaudioside B, rebaudioside D, rebaudioside E and/or rebaudioside M can be produced using whole recombinant cells that are fed raw materials that contain precursor molecules such as steviol and/or steviol glycosides, including mixtures of steviol glycosides derived from plant extracts, wherein said recombinant cells express all or the appropriate combination of UGT polypeptides to effect glucosylation of said steviol to each of the particular glucosylated rebaudiosides. In some embodiments, the recombinant cells can optionally express a transporter, such that they efficiently excrete the rebaudioside without need for permeabilization agents to be added. The raw materials may be fed during cell growth or after cell growth. The whole cells may be in suspension or immobilized. The whole cells may be entrapped in beads, for example calcium or sodium alginate beads. The whole cells may be linked to a hollow fiber tube reactor system. The whole cells may be concentrated and entrapped within a membrane reactor system. The whole cells may be in fermentation broth or in a reaction buffer. In some embodiments, a permeabilizing agent is utilized for efficient transfer of substrate into the cells. In some embodiments, the cells are permeabilized with a solvent such as toluene, or with a detergent such as Triton-X or Tween. In some embodiments, the cells are permeabilized with a surfactant, for example a cationic surfactant such as cetyltrimethylammonium bromide (CTAB). In some embodiments, the cells are permeabilized with periodic mechanical shock such as electroporation or a slight osmotic shock. The cells can contain one recombinant UGT or multiple recombinant UGTs. For example, the cells can contain UGT 76G1 and EUGT11 such that mixtures of stevioside and RebA are efficiently converted to RebD. In some embodiments, the whole cells are the host cells described in section III A. In some embodiments, the whole cells are a Gram-negative bacterium such as E. coli. In some embodiments, the whole cell is a Gram-positive bacterium such as Bacillus. In some embodiments, the whole cell is a fungal species such as Aspergillus, or a yeast such as Saccharomyces. In some embodiments, the term "whole cell biocatalysis" is used to refer to the process in which the whole cells are grown as described above (e.g., in a medium and optionally permeabilized) and a substrate such as rebA or stevioside is provided and converted to the end product using the enzymes from the cells. The cells may or may not be viable, and may or may not be growing during the bioconversion reactions. In contrast, in fermentation, the cells are cultured in a growth medium and fed a carbon and energy source such as glucose and the end product is produced with viable cells.

C. Other Polypeptides

Genes for additional polypeptides whose expression facilitates more efficient or larger scale production of steviol or a steviol glycoside can also be introduced into a recombinant host. For example, a recombinant microorganism can also contain one or more genes encoding a geranylgeranyl diphosphate synthase (GGPPS, also referred to as GGDPS). As another example, the recombinant host can contain one or more genes encoding a rhamnose synthetase, or one or more genes encoding a UDP-glucose dehydrogenase and/or a UDP-glucuronic acid decarboxylase. As another example, a recombinant host can also contain one or more genes encoding a cytochrome P450 reductase (CPR). Expression of a recombinant CPR facilitates the cycling of NADP+ to regenerate NADPH, which is utilized as a cofactor for terpenoid biosynthesis. Other methods can be used to regenerate NADHP levels as well. In circumstances where NADPH becomes limiting; strains can be further modified to include exogenous transhydrogenase genes. See, e.g., Sauer et al. J. Biol. Chem. 279: 6613-6619 (2004). Other methods are known to those with skill in the art to reduce or otherwise modify the ratio of NADH/NADPH such that the desired cofactor level is increased.

As another example, the recombinant host can contain one or more genes encoding one or more enzymes in the MEP pathway or the mevalonate pathway. Such genes are useful because they can increase the flux of carbon into the diterpene biosynthesis pathway, producing geranylgeranyl diphosphate from isopentenyl diphosphate and dimethylallyl diphosphate generated by the pathway. The geranylgeranyl diphosphate so produced can be directed towards steviol and steviol glycoside biosynthesis due to expression of steviol biosynthesis polypeptides and steviol glycoside biosynthesis polypeptides.

As another example the recombinant host can contain one or more genes encoding a sucrose synthase, and additionally can contain sucrose uptake genes if desired. The sucrose synthase reaction can be used to increase the UDP-glucose pool in a fermentation host, or in a whole cell bioconversion process. This regenerates UDP-glucose from UDP produced during glycosylation and sucrose, allowing for efficient glycosylation. In some organisms, disruption of the endogenous invertase is advantageous to prevent degradation of sucrose. For example, the *S. cerevisiae* SUC2 invertase may be disrupted. The sucrose synthase (SUS) can be from any suitable organism. For example, a sucrose synthase coding sequence from, without limitation, *Arabidopsis thaliana*, *Stevia rebaudiana*, or *Coffea arabica* can be cloned into an expression plasmid under control of a suitable promoter, and expressed in a microorganism. The sucrose synthase can be expressed in such a strain in combination with a sucrose transporter (e.g., the *A. thaliana* SUC1 transporter or a functional homolog thereof) and one or more UGTs (e.g., one or more of UGT85C2, UGT74G1, UGT76G1, and UGT91D2e, EUGT11 or functional homologs thereof). Culturing the host in a medium that contains sucrose can promote production of UDP-glucose, as well as one or more glucosides (e.g., steviol glycosides).

Expression of the ERG9 gene, which encodes squalene synthase (SQS), also can be reduced in recombinant hosts such that there is a build-up of precursors to squalene synthase in the recombinant host. SQS is classified under EC 2.5.1.21 and is the first committed enzyme of the biosynthesis pathway that leads to the production of sterols. It catalyzes the synthesis of squalene from farnesyl pyrophosphate via the intermediate presqualene pyrophosphate. This enzyme is a critical branch point enzyme in the biosynthesis of terpenoids/isoprenoids and is thought to regulate the flux of isoprene intermediates through the sterol pathway. The enzyme is sometimes referred to as farnesyl-diphosphate farnesyltransferase (FDFT1). The mechanism of SQS is to convert two units of farnesyl pyrophosphate into squalene. SQS is considered to be an enzyme of eukaryotes or advanced organisms, although at least one prokaryote has been shown to possess a functionally similar enzyme.

Genes for polypeptides whose inactivation facilitates more efficient or larger scale production of steviol or a steviol glycoside can be modified in a recombinant host. For example, an endogenous gene encoding a phosphatase such as the yeast diacylglycerol pyrophosphate phosphatase encoded by the DPP1 gene and/or the yeast lipid phosphate phosphatase encoded by the LPP1 gene can be inactivated such that the degradation of farnesyl pyrophosphate (FPP) to farnesol is reduced and the degradation of geranylgeranylpyrophosphate (GGPP)) to geranylgeraniol (GGOH) is reduced. Such genes can be inactivated or have expression reduced by known techniques such as homologous recombination, mutagenesis, or transcription activator-like effector nucleases (TALENs).

C.1 MEP Biosynthesis Polypeptides

In some embodiments, a recombinant host contains one or more genes encoding enzymes involved in the methylerythritol 4-phosphate (MEP) pathway for isoprenoid biosynthesis. Enzymes in the MEP pathway include deoxyxylulose 5-phosphate synthase (DXS), D-1-deoxyxylulose 5-phosphate reductoisomerase (DXR), 4-diphosphocytidyl-2-C-methyl-D-erythritol synthase (CMS), 4-diphosphocytidyl-2-C-methyl-D-erythritol kinase (CMK), 4-diphosphocytidyl-2-C-methyl-D-erythritol 2,4-cyclodiphosphate synthase (MCS), 1-hydroxy-2-methyl-2(E)-butenyl 4-diphosphate synthase (HDS) and 1-hydroxy-2-methyl-2(E)-butenyl 4-diphosphate reductase (HDR). One or more DXS genes, DXR genes, CMS genes, CMK genes, MCS genes, HDS genes and/or HDR genes can be incorporated into a recombinant microorganism. See, Rodriguez-Concepción and Boronat, Plant Phys. 130: 1079-1089 (2002).

Suitable genes encoding DXS, DXR, CMS, CMK, MCS, HDS and/or HDR polypeptides include those made by *E. coli*, *Arabidopsis thaliana* and *Synechococcus leopoliensis*. Nucleotide sequences encoding DXR polypeptides are described, for example, in U.S. Pat. No. 7,335,815.

C.2 Mevalonate Biosynthesis Polypeptides

In some embodiments, a recombinant host contains one or more genes encoding enzymes involved in the mevalonate pathway for isoprenoid biosynthesis. Genes suitable for transformation into a host encode enzymes in the mevalonate pathway such as a truncated 3-hydroxy-3-methyl-glutaryl (HMG)-CoA reductase (tHMG), and/or a gene encoding a mevalonate kinase (MK), and/or a gene encoding a phosphomevalonate kinase (PMK), and/or a gene encoding a mevalonate pyrophosphate decarboxylase (MPPD). Thus, one or more HMG-CoA reductase genes, MK genes, PMK genes, and/or MPPD genes can be incorporated into a recombinant host such as a microorganism.

Suitable genes encoding mevalonate pathway polypeptides are known. For example, suitable polypeptides include those made by *E. coli*, *Paracoccus denitrificans*, *Saccharomyces cerevisiae*, *Arabidopsis thaliana*, *Kitasatospora griseola*, *Homo sapiens*, *Drosophila melanogaster*, *Gallus gallus*, *Streptomyces* sp. KO-3988, *Nicotiana attenuata*, *Kitasatospora griseola*, *Hevea brasiliensis*, *Enterococcus faecium* and *Haematococcus pluvialis*. See, e.g., Table 9, U.S. Pat. Nos. 7,183,089, 5,460,949, and 5,306,862, and PCT Application Nos. PCT/US2012/050021 and PCT/US2011/038967, which are incorporated herein by reference in their entirety.

TABLE 9

Sources of HMG CoA Reductases and other Mevalonate Genes

| Accession# | Organism | Enzyme | Size (nt) | Gene name |
|---|---|---|---|---|
| XM_001467423 (aa SEQ ID NO: 60) | Leishmania infantum | Acetyl-CoA C-acetyltransferase | 1323 (nt SEQ ID NO: 61) | MEV-4 |
| YML075C (aaSEQ ID NO: 62) | Saccharomyces cerevisiae | Truncated HMG (tHMG1) | 1584 (nt SEQ ID NO: 63) | tHMG1 |
| EU263989 (aaSEQ ID NO: 64) | Ganoderma lucidum | 3-HMG-CoA reductase | 3681 (nt SEQ ID NO: 65) | MEV-11 |
| BC153262 (aa SEQ ID NO: 66) | Bos taurus | 3-HMG-CoA reductase | 2667 (nt SEQ ID NO: 67) | MEV-12 |
| AAD47596 (aa SEQ ID NO: 68) | Artemisia annua | 3-HMG-CoA reductase | 1704 (nt SEQ ID NO: 69) | MEV-13 |
| AAB62280 (aa SEQ ID NO: 70) | Trypanosoma cruzi | 3-HMG-CoA reductase | 1308 (nt SEQ ID NO: 71) | MEV-14 |

TABLE 9-continued

Sources of HMG CoA Reductases and other Mevalonate Genes

| Accession# | Organism | Enzyme | Size (nt) | Gene name |
|---|---|---|---|---|
| CAG41604 (aa SEQ ID NO: 72) | Staph aureus | 3-HMG-CoA reductase | 1281 (nt SEQ ID NO: 73) | MEV-15 |
| DNA2.0 sequence (aa SEQ ID NO: 74) | Archaeoglobus fulgidus | 3-HMG-CoA reductase | 1311 (nt SEQ ID NO: 75) | HMG reductase |
| DNA2.0 sequence (aa SEQ ID NO: 76) | Pseudomonas mevalonii | 3-HMG-CoA reductase | 1287 (nt SEQ ID NO: 77) | HMG reductase |

C.3 Sucrose Synthase Polypeptides

Sucrose synthase (SUS) can be used as a tool for generating UDP-sugar. SUS (EC 2.4.1.13) catalyzes the formation of UDP-glucose and fructose from sucrose and UDP. UDP generated by the reaction of UGTs thus can be converted into UDP-glucose in the presence of sucrose. See, e.g., Chen et al. (2001) J. Am. Chem. Soc. 123:8866-8867; Shao et al. (2003) Appl. Env. Microbiol. 69:5238-5242; Masada et al. (2007) FEBS Lett. 581:2562-2566; and Son et al. (2009) J. Microbiol. Biotechnol. 19:709-712.

Sucrose synthases can be used to generate UDP-glucose and remove UDP, facilitating efficient glycosylation of compounds in various systems. For example, yeast deficient in the ability to utilize sucrose can be made to grow on sucrose by introducing a sucrose transporter and a SUS. For example, Saccharomyces cerevisiae does not have an efficient sucrose uptake system, and relies on extracellular SUC2 to utilize sucrose. The combination of disrupting the endogenous S. cerevisiae SUC2 invertase and expressing recombinant SUS resulted in a yeast strain that was able to metabolize intracellular but not extracellular sucrose (Riesmeier et al. ((1992) EMBO J. 11:4705-4713). The strain was used to isolate sucrose transporters by transformation with a cDNA expression library and selection of transformants that had gained the ability to take up sucrose.

The combined expression of recombinant sucrose synthase and a sucrose transporter in vivo can lead to increased UDP-glucose availability and removal of unwanted UDP. For example, functional expression of a recombinant sucrose synthase, a sucrose transporter, and a glycosyltransferase, in combination with knockout of the natural sucrose degradation system (SUC2 in the case of S. cerevisiae) can be used to generate a cell that is capable of producing increased amounts of glycosylated compounds such as steviol glycosides. This higher glycosylation capability is due to at least (a) a higher capacity for producing UDP-glucose in a more energy efficient manner, and (b) removal of UDP from growth medium, as UDP can inhibit glycosylation reactions.

The sucrose synthase can be from any suitable organism. For example, a sucrose synthase coding sequence from, without limitation, Arabidopsis thaliana (e.g. SEQ ID NO:78), or Coffea arabica (e.g., SEQ ID NO:80) (see, e.g., SEQ ID NOs:178, 179, and 180 of PCT/US2012/050021) can be cloned into an expression plasmid under control of a suitable promoter, and expressed in a host (e.g., a microorganism or a plant). A SUS coding sequence may be expressed in a SUC2 (sucrose hydrolyzing enzyme) deficient S. cerevisiae strain, so as to avoid degradation of extracellular sucrose by the yeast. The sucrose synthase can be expressed in such a strain in combination with a sucrose transporter (e.g., the A. thaliana SUC1 transporter or a functional homolog thereof) and one or more UGTs (e.g., one or more of UGT85C2, UGT74G1, UGT76G1, EUGT11, and UGT91D2e, or functional homologs thereof). Culturing the host in a medium that contains sucrose can promote production of UDP-glucose, as well as one or more glucosides (e.g., steviol glucoside). It is to be noted that in some cases, a sucrose synthase and a sucrose transporter can be expressed along with a UGT in a host cell that also is recombinant for production of a particular compound (e.g., steviol).

C.4 Squalene Synthase Polypeptides

Expression of an endogenous squalene synthase gene can be altered in a recombinant host described herein using a nucleic acid construct containing, for example, two regions that are homologous to parts of the genome sequence within the promoter of a gene encoding a squalene synthase or 5' end of the open reading frame (ORF) encoding squalene synthase, respectively. In yeast, for example, such a construct can contain two regions that are homologous to parts of the genome sequence within the ERG9 promoter or 5' end of the ERG9 open reading frame, respectively. The construct further can include a promoter, such as either the wild type ScKex2 or wild type ScCyc1 for yeast. The promoter further can include a heterologous insert such as a hairpin at its 3'-end. The polypeptide encoded by the ORF has at least 70% identity to a squalene synthase (EC 2.5.1.21) or a biologically active fragment thereof, said fragment having at least 70% sequence identity to said squalene synthase in a range of overlap of at least 100 amino acids. See, for example, PCT/US2012/050021.

The heterologous insert can adapt the secondary structure element of a hairpin with a hairpin loop. The heterologous insert sequence has the general formula (I):

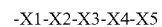

-X1-X2-X3-X4-X5

X2 comprises at least 4 consecutive nucleotides being complementary to, and forming a hairpin secondary structure element with at least 4 consecutive nucleotides of X4, and X3 is optional and if present comprises nucleotides involved in forming a hairpin loop between X2 and X4, and X1 and X5 individually and optionally comprise one or more nucleotides, and X2 and X4 may individually consist of any suitable number of nucleotides, so long as a consecutive sequence of at least 4 nucleotides of X2 is complementary to a consecutive sequence of at least 4 nucleotides of X4. In some embodiments, X2 and X4 consist of the same number of nucleotides.

The heterologous insert is long enough to allow a hairpin to be completed, but short enough to allow limited translation of an ORF that is present in-frame and immediately 3' to the heterologous insert. Typically, the heterologous insert is from 10-50 nucleotides in length, e.g., 10-30 nucleotides, 15-25 nucleotides, 17-22 nucleotides, 18-21 nucleotides, 18-20 nucleotides, or 19 nucleotides in length.

X2 may for example consist of in the range of 4 to 25 nucleotides, such as in the range of 4 to 20, 4 to 15, 6 to 12, 8 to 12, or 9 to 11 nucleotides.

X4 may for example consist of in the range of 4 to 25 nucleotides, such as in the range of 4 to 20, 4 to 15, 6 to 12, 8 to 12, or 9 to 11 nucleotides.

In some embodiments, X2 consists of a nucleotide sequence that is complementary to the nucleotide sequence of X4, all nucleotides of X2 are complementary to the nucleotide sequence of X4.

X3 may be absent, i.e., X3 may consist of zero nucleotides. It is also possible that X3 consists of in the range of 1 to 5 nucleotides, such as in the range of 1 to 3 nucleotides.

X1 may be absent, i.e., X1 may consist of zero nucleotides. It is also possible that X1 consists of in the range of 1 to 25 nucleotides, such as in the range of 1 to 20, 1 to 15, 1 to 10, 1 to 5, or 1 to 3 nucleotides.

X5 may be absent, i.e., X5 may consist of zero nucleotides. It is also possible that X5 may consist of in the range 1 to 5 nucleotides, such as in the range of 1 to 3 nucleotides.

The heterologous insert can be any suitable sequence fulfilling the requirements defined herein. For example, the heterologous insert may comprise tgaattcgttaacgaattc (SEQ ID NO: 81), tgaattcgttaacgaactc (SEQ ID NO: 82), tgaattcgttaacgaagtc (SEQ ID NO: 83), or tgaattcgttaacgaaatt (SEQ ID NO: 84).

Without being bound to a particular mechanism, ERG9 expression in yeast can be decreased by at least partly, sterically hindering binding of the ribosome to the RNA thus reducing the translation of squalene synthase. Using a construct can decrease turnover of farnesyl-pyrophosphate to squalene and/or enhance accumulation of a compound selected from the group consisting of farnesyl-pyrophosphate, isopentenyl-pyrophosphate, dimethylallyl-pyrophosphate, geranyl-pyrophosphate and geranylgeranyl-pyrophosphate.

Occasionally it may be advantageous to include a squalene synthase inhibitor when culturing recombinant hosts described herein. Chemical inhibition of squalene synthase, e.g., by lapaquistat, is known in the art. Other squalene synthase inhibitors include Zaragozic acid and RPR 107393. Thus, in one embodiment the culturing step of the method(s) defined herein are performed in the presence of a squalene synthase inhibitor.

In some embodiments, the recombinant yeast hosts described herein contain a mutation in the ERG9 open reading frame.

In some embodiments, the recombinant yeast hosts described herein contain an ERG9[Δ]::HIS3 deletion/insertion allele.

D. Functional Homologs

Functional homologs of polypeptides described herein are also suitable for use in producing steviol or steviol glycosides in a recombinant host. A functional homolog is a polypeptide that has sequence similarity to a reference polypeptide, and that carries out one or more of the biochemical or physiological function(s) of the reference polypeptide. A functional homolog and the reference polypeptide may be natural occurring polypeptides, and the sequence similarity may be due to convergent or divergent evolutionary events. As such, functional homologs are sometimes designated in the literature as homologs, or orthologs, or paralogs. Variants of a naturally occurring functional homolog, such as polypeptides encoded by mutants of a wild type coding sequence, may themselves be functional homologs. Functional homologs can also be created via site-directed mutagenesis of the coding sequence for a polypeptide, or by combining domains from the coding sequences for different naturally-occurring polypeptides ("domain swapping"). Techniques for modifying genes encoding functional UGT polypeptides described herein are known and include, inter alia, directed evolution techniques, site-directed mutagenesis techniques and random mutagenesis techniques, and can be useful to increase specific activity of a polypeptide, alter substrate specificity, alter expression levels, alter subcellular location, or modify polypeptide:polypeptide interactions in a desired manner. Such modified polypeptides are considered functional homologs. The term "functional homolog" is sometimes applied to the nucleic acid that encodes a functionally homologous polypeptide.

Functional homologs can be identified by analysis of nucleotide and polypeptide sequence alignments. For example, performing a query on a database of nucleotide or polypeptide sequences can identify homologs of steviol or steviol glycoside biosynthesis polypeptides or transporter genes or proteins or transcription factor genes or proteins that regulate expression of at least one transporter gene. Sequence analysis can involve BLAST, Reciprocal BLAST, or PSI-BLAST analysis of nonredundant databases using a GGPPS, a CDPS, a KS, a KO, a KAH or a transporter or transcription factor amino acid sequence as the reference sequence. Amino acid sequence is, in some instances, deduced from the nucleotide sequence. Those polypeptides in the database that have greater than 40% sequence identity are candidates for further evaluation for suitability as a functional homolog for a steviol or steviol glycoside biosynthesis polypeptide or as a functional homolog for a transporter protein or transcription factor that regulates expression of at least one transporter gene. Amino acid sequence similarity allows for conservative amino acid substitutions, such as substitution of one hydrophobic residue for another or substitution of one polar residue for another. If desired, manual inspection of such candidates can be carried out in order to narrow the number of candidates to be further evaluated. Manual inspection can be performed by selecting those candidates that appear to have domains present in steviol biosynthesis polypeptides or transporter protein or transcription factor that regulates expression of at least one transporter gene, e.g., conserved functional domains.

Conserved regions can be identified by locating a region within the primary amino acid sequence of a steviol or a steviol glycoside biosynthesis polypeptide or a transporter gene or transcription factor that regulates expression of at least one transporter gene that is a repeated sequence, forms some secondary structure (e.g., helices and beta sheets), establishes positively or negatively charged domains, or represents a protein motif or domain. See, e.g., the Pfam web site describing consensus sequences for a variety of protein motifs and domains on the World Wide Web at sanger.ac.uk/Software/Pfam/ and pfam.janelia.org/. The information included at the Pfam database is described in Sonnhammer et al. Nucl. Acids Res. 26: 320-322 (1998); Sonnhammer et al. Proteins 28: 405-420 (1997); and Bateman et al. Nucl. Acids Res. 27: 260-262 (1999). Conserved regions also can be determined by aligning sequences of the same or related polypeptides from closely related species. Closely related species preferably are from the same family. In some embodiments, alignment of sequences from two different species is adequate.

Typically, polypeptides that exhibit at least about 40% amino acid sequence identity are useful to identify conserved regions. Conserved regions of related polypeptides exhibit at least 45% amino acid sequence identity (e.g., at least 50%, at least 60%, at least 70%, at least 80%, or at least 90% amino acid sequence identity). In some embodiments, a conserved region exhibits at least 92%, 94%, 96%, 98%, or 99% amino acid sequence identity.

For example, polypeptides suitable for producing steviol glycosides in a recombinant host include functional homologs of EUGT11, UGT91D2e, UGT91D2m, UGT85C, and UGT76G. Such homologs have greater than 90% (e.g., at least 95% or 99%) sequence identity to the amino acid sequence of EUGT11, UGT91D2e, UGT91D2m, UGT85C, or UGT76G as set forth in PCT Application No. PCT/US2012/050021. Variants of EUGT11, UGT91D2, UGT85C, and UGT76G polypeptides typically have 10 or fewer amino acid substitutions within the primary amino acid sequence, e.g., 7 or fewer amino acid substitutions, 5 or conservative amino acid substitutions, or between 1 and 5 substitutions. However, in some embodiments, variants of EUGT11, UGT91D2, UGT85C, and UGT76G polypeptides can have 10 or more amino acid substitutions (e.g., 10, 15, 20, 25, 30, 35, 10-20, 10-35, 20-30, or 25-35 amino acid substitutions). The substitutions may be conservative, or in some embodiments, non-conservative. Non-limiting examples of non-conservative changes in UGT91D2e polypeptides include glycine to arginine and tryptophan to arginine. Non-limiting examples of non-conservative substitutions in UGT76G polypeptides include valine to glutamic acid, glycine to glutamic acid, glutamine to alanine, and serine to proline. Non-limiting examples of changes to UGT85C polypeptides include histidine to aspartic acid, proline to serine, lysine to threonine, and threonine to arginine.

In some embodiments, a useful UGT91D2 homolog can have amino acid substitutions (e.g., conservative amino acid substitutions) in regions of the polypeptide that are outside of predicted loops, e.g., residues 20-26, 39-43, 88-95, 121-124, 142-158, 185-198, and 203-214 are predicted loops in the N-terminal domain and residues 381-386 are predicted loops in the C-terminal domain of UGT91D2e (see SEQ ID NO: 54). For example, a useful UGT91D2 homolog can include at least one amino acid substitution at residues 1-19, 27-38, 44-87, 96-120, 125-141, 159-184, 199-202, 215-380, or 387-473. In some embodiments, a UGT91D2 homolog can have an amino acid substitution at one or more residues selected from the group consisting of residues 30, 93, 99, 122, 140, 142, 148, 153, 156, 195, 196, 199, 206, 207, 211, 221, 286, 343, 427, and 438. For example, a UGT91D2 functional homolog can have an amino acid substitution at one or more of residues 206, 207, and 343, such as an arginine at residue 206, a cysteine at residue 207, and an arginine at residue 343. See, for example SEQ ID NO: 86. Other functional homologs of UGT91D2 can have one or more of the following: a tyrosine or phenylalanine at residue 30, a proline or glutamine at residue 93, a serine or valine at residue 99, a tyrosine or a phenylalanine at residue 122, a histidine or tyrosine at residue 140, a serine or cysteine at residue 142, an alanine or threonine at residue 148, a methionine at residue 152, an alanine at residue 153, an alanine or serine at residue 156, a glycine at residue 162, a leucine or methionine at residue 195, a glutamic acid at residue 196, a lysine or glutamic acid at residue 199, a leucine or methionine at residue 211, a leucine at residue 213, a serine or phenylalanine at residue 221, a valine or isoleucine at residue 253, a valine or alanine at residue 286, a lysine or asparagine at residue 427, an alanine at residue 438, and either an alanine or threonine at residue 462. In another embodiment, a UGT91D2 functional homolog contains a methionine at residue 211 and an alanine at residue 286.

In some embodiments, a useful UGT85C homolog can have one or more amino acid substitutions at residues 9, 10, 13, 15, 21, 27, 60, 65, 71, 87, 91, 220, 243, 270, 289, 298, 334, 336, 350, 368, 389, 394, 397, 418, 420, 440, 441, 444, and 471. Non-limiting examples of useful UGT85C homologs include polypeptides having substitutions (with respect to SEQ ID NO: 30) at residue 65 (e.g., a serine at residue 65), at residue 65 in combination with residue 15 (a leucine at residue 15), 270 (e.g., a methionine, arginine, or alanine at residue 270), 418 (e.g., a valine at residue 418), 440 (e.g., an aspartic acid at residue at residue 440), or 441 (e.g., an asparagine at residue 441); residues 13 (e.g., a phenylalanine at residue 13), 15, 60 (e.g., an aspartic acid at residue 60), 270, 289 (e.g., a histidine at residue 289), and 418; substitutions at residues 13, 60, and 270; substitutions at residues 60 and 87 (e.g., a phenylalanine at residue 87); substitutions at residues 65, 71 (e.g., a glutamine at residue 71), 220 (e.g., a threonine at residue 220), 243 (e.g., a tryptophan at residue 243), and 270; substitutions at residues 65, 71, 220, 243, 270, and 441; substitutions at residues 65, 71, 220, 389 (e.g., a valine at residue 389), and 394 (e.g., a valine at residue 394); substitutions at residues 65, 71, 270, and 289; substitutions at residues 220, 243, 270, and 334 (e.g., a serine at residue 334); or substitutions at residues 270 and 289. The following amino acid mutations did not result in a loss of activity in 85C2 polypeptides: V13F, F15L, H60D, A65S, E71Q, I87F, K220T, R243W, T270M, T270R, Q289H, L334S, A389V, I394V, P397S, E418V, G440D, and H441N. Additional mutations that were seen in active clones include K9E, K10R, Q21H, M27V, L91P, Y298C, K350T, H368R, G420R, L431P, R444G, and M471T. In some embodiments, an UGT85C2 contains substitutions at positions 65 (e.g., a serine), 71 (a glutamine), 270 (a methionine), 289 (a histidine), and 389 (a valine).

The amino acid sequence of Stevia rebaudiana UGTs 74G1, 76G1 and 91D2e with N-terminal, in-frame fusions of the first 158 amino acids of human MDM2 protein, and Stevia rebaudiana UGT85C2 with an N-terminal in-frame fusion of 4 repeats of the synthetic PMI peptide (4 X TSFAEYWNLLSP, SEQ ID NO:87) as set forth in SEQ ID NOs: 88, 89, 90, and 91.

In some embodiments, a useful UGT76G homolog can have one or more amino acid substitutions at residues 29, 74, 87, 91, 116, 123, 125, 126, 130, 145, 192, 193, 194, 196, 198, 199, 200, 203, 204, 205, 206, 207, 208, 266, 273, 274, 284, 285, 291, 330, 331, and 346 of SEQ ID NO: 85.

Non-limiting examples of useful UGT76G homologs include polypeptides having substitutions at residues 74, 87, 91, 116, 123, 125, 126, 130, 145, 192, 193, 194, 196, 198, 199, 200, 203, 204, 205, 206, 207, 208, and 291; residues 74, 87, 91, 116, 123, 125, 126, 130, 145, 192, 193, 194, 196, 198, 199, 200, 203, 204, 205, 206, 207, 208, 266, 273, 274, 284, 285, and 291; or residues 74, 87, 91, 116, 123, 125, 126, 130, 145, 192, 193, 194, 196, 198, 199, 200, 203, 204, 205, 206, 207, 208, 266, 273, 274, 284, 285, 291, 330, 331, and 346. See, Table 10.

TABLE 10

| Clone | Mutations |
| --- | --- |
| 76G_G7 | M29I, V74E, V87G, L91P, G116E, A123T, Q125A, I126L, T130A, V145M, C192S, S193A, F194Y, M196N, K198Q, K199I, Y200L, Y203I, F204L, E205G, N206K, I207M, |

TABLE 10-continued

| Clone | Mutations |
|---|---|
| | T208I, P266Q, S273P, R274S, G284T, T285S, 287-3 by deletion, L330V, G331A, L346I |
| 76G_H12 | M29I, V74E, V87G, L91P, G116E, A123T, Q125A, I126L, T130A, V145M, C192S, S193A, F194Y, M196N, K198Q, K199I, Y200L, Y203I, F204L, E205G, N206K, I207M, T208I, P266Q, S273P, R274S, G284T, T285S, 287-3 by deletion |
| 76G_C4 | M29I, V74E, V87G, L91P, G116E, A123T, Q125A, I126L, T130A, V145M, C192S, S193A, F194Y, M196N, K198Q, K199I, Y200L, Y203I, F204L, E205G, N206K, I207M, T208I |

Methods to modify the substrate specificity of, for example, EUGT11 or UGT91D2e, are known to those skilled in the art, and include without limitation site-directed/rational mutagenesis approaches, random directed evolution approaches and combinations in which random mutagenesis/saturation techniques are performed near the active site of the enzyme. For example see Osmani et al. Phytochemistry 70: 325-347 (2009).

A candidate sequence typically has a length that is from 80 percent to 200 percent of the length of the reference sequence, e.g., 82, 85, 87, 89, 90, 93, 95, 97, 99, 100, 105, 110, 115, 120, 130, 140, 150, 160, 170, 180, 190, or 200 percent of the length of the reference sequence. A functional homolog polypeptide typically has a length that is from 95 percent to 105 percent of the length of the reference sequence, e.g., 90, 93, 95, 97, 99, 100, 105, 110, 115, or 120 percent of the length of the reference sequence, or any range between. A percent identity for any candidate nucleic acid or polypeptide relative to a reference nucleic acid or polypeptide can be determined as follows. A reference sequence (e.g., a nucleic acid sequence or an amino acid sequence) is aligned to one or more candidate sequences using the computer program ClustalW (version 1.83, default parameters), which allows alignments of nucleic acid or polypeptide sequences to be carried out across their entire length (global alignment). Chenna et al., Nucleic Acids Res., 31(13):3497-500 (2003).

ClustalW calculates the best match between a reference and one or more candidate sequences, and aligns them so that identities, similarities and differences can be determined. Gaps of one or more residues can be inserted into a reference sequence, a candidate sequence, or both, to maximize sequence alignments. For fast pairwise alignment of nucleic acid sequences, the following default parameters are used: word size: 2; window size: 4; scoring method: percentage; number of top diagonals: 4; and gap penalty: 5. For multiple alignment of nucleic acid sequences, the following parameters are used: gap opening penalty: 10.0; gap extension penalty: 5.0; and weight transitions: yes. For fast pairwise alignment of protein sequences, the following parameters are used: word size: 1; window size: 5; scoring method: percentage; number of top diagonals: 5; gap penalty: 3. For multiple alignment of protein sequences, the following parameters are used: weight matrix: blosum; gap opening penalty: 10.0; gap extension penalty: 0.05; hydrophilic gaps: on; hydrophilic residues: Gly, Pro, Ser, Asn, Asp, Gln, Glu, Arg, and Lys; residue-specific gap penalties: on. The ClustalW output is a sequence alignment that reflects the relationship between sequences. ClustalW can be run, for example, at the Baylor College of Medicine Search Launcher site on the World Wide Web (searchlauncher.bcm.tmc.edu/multi-align/multi-align.html) and at the European Bioinformatics Institute site on the World Wide Web (ebi.ac.uk/clustalw).

To determine percent identity of a candidate nucleic acid or amino acid sequence to a reference sequence, the sequences are aligned using ClustalW, the number of identical matches in the alignment is divided by the length of the reference sequence, and the result is multiplied by 100. It is noted that the percent identity value can be rounded to the nearest tenth. For example, 78.11, 78.12, 78.13, and 78.14 are rounded down to 78.1, while 78.15, 78.16, 78.17, 78.18, and 78.19 are rounded up to 78.2.

It will be appreciated that functional UGTs can include additional amino acids that are not involved in glucosylation or other enzymatic activities carried out by the enzyme, and thus such a polypeptide can be longer than would otherwise be the case. For example, a EUGT11 polypeptide can include a purification tag (e.g., HIS tag or GST tag), a chloroplast transit peptide, a mitochondrial transit peptide, an amyloplast peptide, signal peptide, or a excretion tag added to the amino or carboxy terminus. In some embodiments, a EUGT11 polypeptide includes an amino acid sequence that functions as a reporter, e.g., a green fluorescent protein or yellow fluorescent protein.

II. Steviol and Steviol Glycoside Biosynthesis Nucleic Acids

A recombinant gene encoding a polypeptide described herein comprises the coding sequence for that polypeptide, operably linked in sense orientation to one or more regulatory regions suitable for expressing the polypeptide. Because many microorganisms are capable of expressing multiple gene products from a polycistronic mRNA, multiple polypeptides can be expressed under the control of a single regulatory region for those microorganisms, if desired. A coding sequence and a regulatory region are considered to be operably linked when the regulatory region and coding sequence are positioned so that the regulatory region is effective for regulating transcription or translation of the sequence. Typically, the translation initiation site of the translational reading frame of the coding sequence is positioned between one and about fifty nucleotides downstream of the regulatory region for a monocistronic gene.

In many cases, the coding sequence for a polypeptide described herein is identified in a species other than the recombinant host, i.e., is a heterologous nucleic acid. Thus, if the recombinant host is a microorganism, the coding sequence can be from other prokaryotic or eukaryotic microorganisms, from plants or from animals. In some case, however, the coding sequence is a sequence that is native to the host and is being reintroduced into that organism. A native sequence can often be distinguished from the naturally occurring sequence by the presence of non-natural sequences linked to the exogenous nucleic acid, e.g., non-native regulatory sequences flanking a native sequence in a recombinant nucleic acid construct. In addition, stably transformed exogenous nucleic acids typically are integrated at positions other than the position where the native sequence is found. "Regulatory region" refers to a nucleic acid having nucleotide sequences that influence transcription or translation initiation and rate, and stability and/or mobility of a transcription or translation product. Regulatory regions include, without limitation, promoter sequences, enhancer sequences, response elements, protein recognition sites, inducible elements, protein binding sequences, 5' and 3' untranslated regions (UTRs), transcriptional start sites, termination sequences, polyadenylation sequences, introns, and combinations thereof. A regulatory region typically comprises at least a core (basal) promoter. A regulatory region also may include at least one control element, such as an enhancer sequence, an upstream element or an upstream activation region (UAR). A regulatory region is operably linked to a coding sequence by positioning the regulatory region and the coding sequence so that the regulatory region is effective for regulating transcription or translation of the sequence. For example, to operably link a coding sequence and a promoter sequence, the translation initiation site of the translational reading frame of the coding sequence is typically positioned between one and about fifty nucleotides downstream of the promoter. A regulatory region can, however, be positioned as much as about 5,000 nucleotides upstream of the translation initiation site, or about 2,000 nucleotides upstream of the transcription start site.

The choice of regulatory regions to be included depends upon several factors, including, but not limited to, efficiency, selectability, inducibility, desired expression level, and preferential expression during certain culture stages. It is a routine matter for one of skill in the art to modulate the expression of a coding sequence by appropriately selecting and positioning regulatory regions relative to the coding sequence. It will be understood that more than one regulatory region may be present, e.g., introns, enhancers, upstream activation regions, transcription terminators, and inducible elements.

One or more genes can be combined in a recombinant nucleic acid construct in "modules" useful for a discrete aspect of steviol and/or steviol glycoside production. Combining a plurality of genes in a module, particularly a polycistronic module, facilitates the use of the module in a variety of species. For example, a steviol biosynthesis gene cluster, or a UGT gene cluster, can be combined in a polycistronic module such that, after insertion of a suitable regulatory region, the module can be introduced into a wide variety of species. As another example, a UGT gene cluster can be combined such that each UGT coding sequence is operably linked to a separate regulatory region, to form a UGT module. Such a module can be used in those species for which monocistronic expression is necessary or desirable. In addition to genes useful for steviol or steviol glycoside production, a recombinant construct typically also contains an origin of replication, and one or more selectable markers for maintenance of the construct in appropriate species.

It will be appreciated that because of the degeneracy of the genetic code, a number of nucleic acids can encode a particular polypeptide; i.e., for many amino acids, there is more than one nucleotide triplet that serves as the codon for the amino acid. Thus, codons in the coding sequence for a given polypeptide can be modified such that optimal expression in a particular host is obtained, using appropriate codon bias tables for that host (e.g., microorganism). As isolated nucleic acids, these modified sequences can exist as purified molecules and can be incorporated into a vector or a virus for use in constructing modules for recombinant nucleic acid constructs.

In some cases, it is desirable to inhibit one or more functions of an endogenous polypeptide in order to divert metabolic intermediates towards steviol or steviol glycoside biosynthesis. For example, it may be desirable to downregulate synthesis of sterols in a yeast strain in order to further increase steviol or steviol glycoside production, e.g., by downregulating squalene epoxidase. As another example, it may be desirable to inhibit degradative functions of certain endogenous gene products, e.g., glycohydrolases that remove glucose moieties from secondary metabolites or phosphatases as discussed herein. As another example, expression of membrane transporters involved in transport of steviol glycosides can be inhibited, such that excretion of glycosylated stevio sides is inhibited. Such regulation can be beneficial in that excretion of steviol glycosides can be inhibited for a desired period of time during culture of the microorganism, thereby increasing the yield of glycoside product(s) at harvest. In such cases, a nucleic acid that inhibits expression of the polypeptide or gene product may be included in a recombinant construct that is transformed into the strain. Alternatively, mutagenesis can be used to generate mutants in genes for which it is desired to inhibit function.

III. Expressing Transporters

The present document is directed to recombinant host cells in which expression of endogenous transporter genes is modified or in which heterologous transporter genes are expressed. In some embodiments, expression of an endogenous transporter can be modified by replacing the endogenous promoter with a different promoter that results in increased expression of the transporter protein (e.g., at least a 5% increase in expression, such as at least a 10%, 15%, 20%, or 25% increase in expression). For example, an endogenous promoter can be replaced with a constitutive or inducible promoter that results in increased expression of the transporter. Homologous recombination can be used to replace the promoter of an endogenous gene with a different promoter that results in increased expression of the transporter. In other embodiments the inducible or constitutive promoter and endogenous transporter or transcription factor gene can be integrated into another locus of the genome using homologous recombination. In other embodiments, the transporter gene can be introduced into a microorganism using exogenous plasmids with a promoter that results in overexpression of the transporter in the microorganism. In yet another embodiment, the exogenous plasmids may also contain multiple copies of the transporter gene. In a further embodiment, the endogenous transporter can be induced to be overexpressed using native mechanisms to the recombinant microorganism (e.g. heat shock, stress, heavy metal or antibiotic exposure). For example, oligomycin and/or cadmium can be added to the culture media (wherein YOR1 expression can be induced by said molecules) to increase expression of YOR1 and thereby excretion of steviol glycosides. See, for example Hallstrom & Moye-Rowley (1998) *JBC* 273(4): 2098-104; Nagy et al., (2006) *Biochimie.* 88(11):1665-71; and Katzmann et al., (1995) *Mol Cell Biol.* 15(12):6875-83.

As described herein, increasing expression of certain endogenous transporters or expressing a heterologous transporter in a recombinant host (e.g., expressing an *S. rebaudiana* transporter in a microorganism such as *S. cerevisiae*) can confer the ability to more efficiently produce and secrete steviol glycosides upon that host. The amount of extracellular and/or intracellular steviol glycoside produced during culturing the host can be measured by liquid chromatography-mass spectrometry (LC-MS) as described herein.

A transporter (also referred to as a membrane transport protein) is a membrane protein involved in the movement of molecules and ions across a biological membrane. Transporters span the membrane in which they are localized and across which they transport substances. Transporters can operate to move substances by facilitated diffusion or by active transport. Transport proteins have been classified according to various criteria at the Transporter Classification Database. See, Saier Jr. et al., Nucl. Acids Res., 37:D274-278 (2009). Two families of plasma membrane transporters are thought to be ubiquitous among living organisms: the ATP-Binding Cassette (ABC) transporters and the Major Facilitator Superfamily (MFS) transporters. ATP-binding cassette transporters (ABC transporters) are transmembrane proteins that utilize the energy of adenosine triphosphate (ATP) hydrolysis to carry out translocation of various substrates across membranes. They can transport a wide variety of substrates across extra- and intracellular membranes, including metabolic products, lipids and sterols, and drugs. Proteins are classified as ABC transporters based on the sequence and organization of their ATP-binding cassette domain. Typically, ABC family transporters are multicomponent primary active transporters, capable of transporting molecules in response to ATP hydrolysis. Non-limiting examples of endogenous ABC transporter genes include the genes at the PDR5, PDR10, PDR15, SNQ2, YOR1, YOL075c and PDR18 (or a functional homolog thereof).

The Major Facilitator Superfamily (MFS) transporters are polypeptides that can transport small solutes in response to chemiosmotic ion gradients. Saier, Jr. et al., J. Mol. Microbiol. Biotechnol. 1:257-279 (1999). The MFS transporter family is sometimes referred to as the uniporter-symporter-antiporter family. MFS transporters function in, inter alia, in sugar uptake and drug efflux systems. MFS transporters typically contain conserved MFS-specific motifs. Non-limiting examples of endogenous MFS transporter genes include the genes at the TPO1, TPO3, and FLR1 loci (or a functional homolog thereof).

Other transporter families include the SMR (small multidrug resistant) family, RND (Resistance-Nodulation-Cell Division) family, and the MATE (multidrug and toxic compound extrusion) family. The SMR family members are integral membrane proteins characterized by four alpha-helical transmembrane strands that confer resistance to a broad range of antiseptics, lipophilic quaternary ammonium compounds (QAC), and aminoglycoside resistance in bacteria. See, Bay and Turner, BMC Evol Biol., 9: 140 (2009). For example, EmrE efflux transporter of *Escherichia coli* (GenBank: BAE76318.1; SEQ ID NO: 92) is involved with aminoglycoside resistance. It is a homooligomer that extrudes positively charged aromatic drugs (i.e., methyl viologen or ethidium) in exchange for two protons.

The RND family members are widespread, including among Gram-negative bacteria, and catalyze the active efflux of many antibiotics and chemotherapeutic agents. See, Nikaido and Takatsuk, Biochim Biophys Acta., 1794(5): 769-81 (2009). An exemplary protein is AcrAB from *Escherichia coli* that is involved in erythromycin D transport (GenBank: BAE76241.1; SEQ ID NO: 93, and AAA23410.1; SEQ ID NO: 94).

The MATE family members contain 12 transmembrane (TM) domains. Members of the MATE family have been identified in prokaryotes, yeast such as *Saccharomyces cerevisiae* and *Schizosaccharomyces pombe*, and plants. Diener et al., Plant Cell. 13(7): 1625-1638 (2001). The MATE family members are sodium or proton antiporters. An exemplary target molecule is ydhE from *E. coli* (GenBank AAB47941.1; SEQ ID NO: 95), which transports fluoroquinolones, kanamycin, streptomycin, other aminoglycosides and Berberine.

A. Transcription Factors

Modification of transcription factor expression can also be used to increase transporter expression. For example, the yeast transcriptions factors PDR1 and/or PDR3 regulate expression of the genes encoding ABC transporters PDR5, SNQ2 and YOR1. Therefore, in some embodiments, promoters for the endogenous PDR1 and PDR3 loci can be replaced with a different promoter that results in increased expression of the transcription factors, which can increase production of endogenous transporters. In other embodiments, the transcription factors can be introduced into a microorganism using exogenous plasmids with a promoter that results in overexpression of the transcription factor in the microorganims. In yet another embodiment, the exogenous plasmids may also contain multiple copies of the transcription factor. In a further embodiment, the endogenous transcription factor can be activated or induced to be overexpressed using native mechanisms to the recombinant microorganism (e.g. heat shock, stress, heavy metal or antibiotic exposure).

B. Identifying Genes Affecting Excretion of Steviol Pathway Intermediates

Methods for identifying a gene affecting excretion of steviol pathway intermediates are disclosed herein. Such methods can involve inactivating at least one endogenous transporter gene or modifying expression of at least one transporter gene. Typically, a library of mutant microorganisms is prepared, each mutant in the library having a different endogenous transporter gene inactivated. In some embodiments, expression of a different endogenous transporter gene is modified in each microorganism in the library. The parent microorganism in which the modifications are generated can lack steviol glycoside pathway genes, although it can contain one or more of such genes if desired. Generally, it is more convenient to generate modifications in the absence of steviol glycoside pathway genes, and subsequently introduce those pathway genes that facilitate production of a desired different target glycoside product. The mutant microorganisms containing one or more steviol glycoside pathway genes are cultured in a medium under conditions in which steviol or a steviol glycoside is synthesized, and the amount of extracellular and/or intracellular steviol glycoside pathway intermediates produced by the microorganism is measured (e.g., using LC-MS) as described herein.

The intermediate(s) that is characterized depends upon the particular pathway of interest in the microorganism. For example, a microorganism expressing the 76G1, 74G1, 91D2e, and 85C2 UGTs (described below) can synthesize the target product rebaudioside A from steviol, via intermediate compounds steviol-19-O-glucoside (19-SMG), rubusoside and stevioside. See FIG. 1. Thus, if rebaudioside A is the target product, the amount of 19-SMG excreted by the microorganism into the culture supernatant and the amount of 19-SMG retained inside the microorganism can be measured. The amount of an individual intermediate or the amounts of each intermediate produced during culture of the microorganism can be measured. If the amount of extracellular pathway intermediate(s) produced by the mutant microorganism is greater than the amount produced by the corresponding microorganism that is wild-type for the transporter gene, the endogenous transporter gene is identified as affecting excretion of steviol pathway intermediates. A similar method can be used to determine if a transporter affects excretion of other intermediates.

IV. Inactivating Endogenous Transporters

The present document can be directed to recombinant hosts comprising one or more inactivated endogenous transporter genes. An endogenous transporter gene typically is inactivated by disrupting expression of the gene or introducing a mutation to reduce or even completely eliminate transporter activity in a host comprising the mutation, e.g., a disruption in one or more endogenous transporter genes, such that the host has reduced transporter expression or activity for the transporter encoded by the disrupted gene.

In some embodiments, a transporter that is knocked out can also have specificity for excretion of larger molecular weight rebaudiosides (for example, RebA), and therefore, can be useful to overexpress in strains where excretion of RebA into the medium is desired. With appropriate balancing of the rate of glycosylation activity through expression of pathway UGTs, smaller molecular weight steviol glycosides are further glycosylated before they are excreted into the medium. For example, higher expression levels of a UGT76G1 and UGT91D2e and/or EUGT11 as compared to the UGT74G1 and UGT85C2 enzymes can prevent accumulation of the steviol monoglucosides that are excreted more readily. If the UGT activity level is higher (so the glycosylation rate is faster) than the rate of transport, then more larger molecular weight steviol glycosides will be produced.

Since many transporters have overlapping substrate specificity and since disruptions in certain transporters are compensated for by up-regulation of other transporters, it is often useful to generate a host that contains a plurality of inactivated transporter genes. For example, as described herein, the PDR5, PDR10, PDR15 and SNQ2 loci can be disrupted as set forth in the Examples below. In some embodiments, the TPO1, PDR5, PDR10, PDR15 and SNQ2 loci can be disrupted as set forth in the Examples below.

Additional transporter genes that can be inactivated can be identified based on the function of related sequences, e.g., the sequences found at the yeast PDR5, PDR10, PDR15 and SNQ2 loci. Endogenous transporter genes can be inactivated by mutations that disrupt the gene. For example, a gene replacement vector can be constructed in such a way to include a selectable marker gene flanked at both the 5' and 3' ends by portions of the transporter gene of sufficient length to mediate homologous recombination. The selectable marker can be one of any number of genes that complement host cell auxotrophy, provide antibiotic resistance, or result in a color change. Linearized DNA fragments of the gene replacement vector, containing no plasmid DNA or ars element, are then introduced into cells using known methods. Integration of the linear fragment into the genome and the disruption of the transporter gene can be determined based on the selection marker and can be verified by, for example, Southern blot analysis. The resulting cells contain an inactivated mutant transporter gene, due to insertion of the selectable marker at the locus for the transporter. A deletion-disruption gene replacement vector can be constructed in a similar way using known techniques and, by way of homologous recombination, integrated in the endogenous transporter gene, thereby inactivating it. In some embodiments, the selectable marker can be removed from the genome of the host cell after determining that the desired disruption mutation has been introduced. See, e.g., Gossen et al. (2002) *Ann. Rev. Genetics* 36:153-173 and U.S. Application Publication No. 20060014264.

Endogenous transporter genes can also be inactivated by utilizing transcription activator-like effector nucleases (TALENs) or modified zinc finger nucleases to introduce desired insertion or deletion mutations. See, US Patent Publication No. 2012-0178169. In some embodiments, an endogenous transporter gene is inactivated by introducing a mutation that results in insertions of nucleotides, deletions of nucleotides, or transition or transversion point mutations in the wild-type transporter gene sequence. Other types of mutations that may be introduced in a transporter gene include duplications and inversions in the wild-type sequence. Mutations can be made in the coding sequence at a transporter locus, as well as in noncoding sequences such as regulatory regions, introns, and other untranslated sequences. Mutations in the coding sequence can result in insertions of one or more amino acids, deletions of one or more amino acids, and/or non-conservative amino acid substitutions in the corresponding gene product. In some cases, the sequence of a transporter gene comprises more than one mutation or more than one type of mutation. Insertion or deletion of amino acids in a coding sequence can, for example, disrupt the conformation of a substrate binding pocket of the resulting gene product.

Amino acid insertions or deletions can also disrupt catalytic sites important for gene product activity. It is known in the art that the insertion or deletion of a larger number of contiguous amino acids is more likely to render the gene product non-functional, compared to a smaller number of inserted or deleted amino acids. Non-conservative substitutions can make a substantial change in the charge or hydrophobicity of the gene product. Non-conservative amino acid substitutions can also make a substantial change in the bulk of the residue side chain, e.g., substituting an alanine residue for a isoleucine residue. Examples of non-conservative substitutions include a basic amino acid for a non-polar amino acid, or a polar amino acid for an acidic amino acid.

In some embodiments, a mutation in a transporter gene may result in no amino acid changes but, although not affecting the amino acid sequence of the encoded transporter, may alter transcriptional levels (e.g., increasing or decreasing transcription), decrease translational levels, alter secondary structure of DNA or mRNA, alter binding sites for transcriptional or translational machinery, or decrease tRNA binding efficiency.

Mutations in transporter loci can be generated by site-directed mutagenesis of the transporter gene sequence in vitro, followed by homologous recombination to introduce the mutation into the host genome as described above. However, mutations can also be generated by inducing mutagenesis in cells of the host, using a mutagenic agent to induce genetic mutations within a population of cells. Mutagenesis is particularly useful for those species or strains for which in vitro mutagenesis and homologous recombination is less well established or is inconvenient. The dosage of the mutagenic chemical or radiation for a particular species or strain is determined experimentally such that a mutation frequency is obtained that is below a threshold level characterized by lethality or reproductive sterility.

A. Transcription Factors

Modification of transcription factor expression can also be used to reduce or eliminate transporter expression. For example, the yeast transcriptions factors PDR1 and/or PDR3 regulate expression of the genes encoding ABC transporters PDR5, SNQ2 and YOR1. Disrupting the loci or reducing expression of PDR1 and/or PDR3 can result in a detectable decrease in excretion of steviol glycoside intermediates. Therefore, in some embodiments, a yeast host contains inactivated endogenous PDR1 and PDR3 loci in combination with a plurality of inactivated transporter genes, to provide a larger reduction in excretion of intermediates than that provided by inactivation of any single transporter or transcription factor. In another embodiment, a transcription factor identified to decrease steviol glycoside excretion by disrupting or reducing the transcription factor's expression, can then be overexpressed in a recombinant microorganism in order to increase excretion of steviol glycosides.

B. Identifying Genes Affecting Excretion of Steviol Pathway Intermediates

Methods for identifying a gene affecting excretion of steviol pathway intermediates are disclosed herein. Such methods involve inactivating, disrupting or decreasing expression of at least one endogenous transporter gene. Typically, a library of mutant microorganisms is prepared, each mutant in the library having a different endogenous transporter gene inactivated, disrupted or with decreased expression. The parent microorganism in which the mutations are generated can lack steviol glycoside pathway genes, although it can contain one or more of such genes. Generally, it is more convenient to generate mutations in the absence of steviol glycoside pathway genes, and subsequently introduce those pathway genes that facilitate production of a desired different target glycoside product. The mutant microorganisms containing one or more steviol glycoside pathway genes can be cultured in a medium under conditions in which steviol or a steviol glycoside is synthesized, and the amount of extracellular and/or intracellular steviol glycoside pathway intermediates produced by the microorganism can be measured.

The intermediate(s) that is characterized depends upon the particular pathway of interest in the microorganism. For example, a microorganism expressing the 76G1, 74G1, 91D2e, and 85C2 UGTs (described below) can synthesize the target product rebaudioside A from steviol, via intermediate compounds steviol-19-O-glucoside (19-SMG), steviol-13-O-glucose (13-SMG), rubusoside and stevioside. See FIG. 1. Thus, if rebaudioside A is the target product, the amount of 19-SMG excreted by the microorganism into the culture supernatant and the amount of 19-SMG retained inside the microorganism can be measured (e.g., using liquid chromatography-mass spectrometry (LC-MS)). The amount of an individual intermediate or the amounts of each intermediate produced during culture of the microorganism can be measured. If the amount of extracellular pathway intermediate(s) produced by the mutant microorganism is greater than the amount produced by the corresponding microorganism that is wild-type for the transporter gene, the endogenous transporter gene is identified as affecting excretion of steviol pathway intermediates. A similar method can be used to determine if a transporter affects excretion of other intermediates.

V. Hosts

A number of prokaryotes and eukaryotes are suitable for use in constructing the recombinant microorganisms described herein, e.g., gram-negative bacteria, yeast and fungi. A species and strain selected for use as a steviol or steviol glycoside production strain is first analyzed to determine which production genes are endogenous to the strain and which genes are not present. Genes for which an endogenous counterpart is not present in the strain are assembled in one or more recombinant constructs, which are then transformed into the strain in order to supply the missing function(s).

Exemplary prokaryotic and eukaryotic species are described in more detail below. However, it will be appreciated that other species may be suitable. For example, suitable species may be in *Saccharomycetes*. Additional suitable species may be in a genus selected from the group consisting of *Agaricus, Aspergillus, Bacillus, Candida, Corynebacterium, Escherichia, Fusarium/Gibberella, Kluyveromyces, Laetiporus, Lentinus, Phaffia, Phanerochaete, Pichia, Physcomitrella, Rhodoturula, Saccharomyces, Schizosaccharomyces, Sphaceloma, Xanthophyllomyces* and *Yarrowia*.

Exemplary species from such genera include *Lentinus tigrinus, Laetiporus sulphureus, Phanerochaete chrysosporium, Pichia pastoris, Physcomitrella patens, Rhodoturula glutinis 32, Rhodoturula mucilaginosa, Phaffia rhodozyma* UBV-AX, *Xanthophyllomyces dendrorhous, Fusarium fujikuroi/Gibberella fujikuroi, Candida utilis* and *Yarrowia lipolytica*. In some embodiments, a microorganism can be an Ascomycete such as *Gibberella fujikuroi, Kluyveromyces lactis, Schizosaccharomyces pombe, Aspergillus niger,* or *Saccharomyces cerevisiae*. In some embodiments, a microorganism can be a prokaryote such as *Escherichia coli, Rhodobacter sphaeroides*, or *Rhodobacter capsulatus*. It will be appreciated that certain microorganisms can be used to screen and test genes of interest in a high throughput manner, while other microorganisms with desired productivity or growth characteristics can be used for large-scale production of steviol glycosides.

*Saccharomyces cerevisiae* and Related Yeast Species

*Saccharomyces cerevisiae* is a widely used chassis organism in synthetic biology, and can be used as the recombinant microorganism platform. There are libraries of mutants, plasmids, detailed computer models of metabolism and other information available for *S. cerevisiae*, allowing for rational design of various modules to enhance product yield. Methods are known for making recombinant microorganisms. A steviol biosynthesis gene cluster can be expressed in yeast, particularly *Saccharomycetes*, using any of a number of known promoters. Strains that overproduce terpenes are known and can be used to increase the amount of geranylgeranyl diphosphate available for steviol and steviol glycoside production. *Saccharomyces cerevisiae* is an exemplary *Saccharomyces* species.

*Aspergillus* spp.

*Aspergillus* species such as *A. oryzae, A. niger* and *A. sojae* are widely used microorganisms in food production, and can also be used as the recombinant microorganism platform. Nucleotide sequences are available for genomes of *A. nidulans, A. fumigatus, A. oryzae, A. clavatus, A. flavus, A. niger,* and *A. terreus*, allowing rational design and modification of endogenous pathways to enhance flux and increase product yield. Metabolic models have been developed for *Aspergillus*, as well as transcriptomic studies and proteomics studies. *A. niger* is cultured for the industrial production of a number of food ingredients such as citric acid and gluconic acid, and thus species such as *A. niger* are generally suitable for the production of food ingredients such as steviol and steviol glycosides.

*Escherichia coli*

*Escherichia coli*, another widely used platform organism in synthetic biology, can also be used as the recombinant microorganism platform. Similar to *Saccharomyces*, there are libraries of mutants, plasmids, detailed computer models of metabolism and other information available for *E. coli*, allowing for rational design of various modules to enhance product yield. Methods similar to those described above for *Saccharomyces* can be used to make recombinant *E. coli* microorganisms.

*Agaricus, Gibberella,* and *Phanerochaete* spp.

*Agaricus, Gibberella,* and *Phanerochaete* spp. can be useful because they are known to produce large amounts of gibberellin in culture. Thus, the terpene precursors for producing large amounts of steviol and steviol glycosides are already produced by endogenous genes. Thus, modules containing recombinant genes for steviol or steviol glycoside biosynthesis polypeptides can be introduced into species from such genera without the necessity of introducing mevalonate or MEP pathway genes.

*Arxula adeninivorans* (*Blastobotrys adeninivorans*)

*Arxula adeninivorans* is a dimorphic yeast (it grows as a budding yeast like the baker's yeast up to a temperature of 42° C., above this threshold it grows in a filamentous form)

with unusual biochemical characteristics. It can grow on a wide range of substrates and can assimilate nitrate. It has successfully been applied to the generation of strains that can produce natural plastics or the development of a biosensor for estrogens in environmental samples.

*Yarrowia lipolytica*

*Yarrowia lipolytica* is a dimorphic yeast (see *Arxula adeninivorans*) that can grow on a wide range of substrates. It has a high potential for industrial applications but there are no recombinant products commercially available yet.

*Rhodobacter* spp.

*Rhodobacter* can be use as the recombinant microorganism platform. Similar to *E. coli*, there are libraries of mutants available as well as suitable plasmid vectors, allowing for rational design of various modules to enhance product yield. Isoprenoid pathways have been engineered in membraneous bacterial species of *Rhodobacter* for increased production of carotenoid and CoQ10. See, U.S. Patent Publication Nos. 20050003474 and 20040078846. Methods similar to those described above for *E. coli* can be used to make recombinant *Rhodobacter* microorganisms.

*Candida boidinii*

*Candida boidinii* is a methylotrophic yeast (it can grow on methanol). Like other methylotrophic species such as *Hansenula polymorphs* and *Pichia pastoris*, it provides an excellent platform for the production of heterologous proteins. Yields in a multigram range of a excreted foreign protein have been reported. A computational method, IPRO, recently predicted mutations that experimentally switched the cofactor specificity of *Candida boidinii* xylose reductase from NADPH to NADH.

*Hansenula polymorpha* (*Pichia angusta*)

*Hansenula polymorpha* is another methylotrophic yeast (see *Candida boidinii*). It can furthermore grow on a wide range of other substrates; it is thermo-tolerant and can assimilate nitrate (see also *Kluyveromyces lactis*). It has been applied to the production of hepatitis B vaccines, insulin and interferon alpha-2a for the treatment of hepatitis C, furthermore to a range of technical enzymes.

*Kluyveromyces lactis*

*Kluyveromyces lactis* is a yeast regularly applied to the production of kefir. It can grow on several sugars, most importantly on lactose which is present in milk and whey. It has successfully been applied among others to the production of chymosin (an enzyme that is usually present in the stomach of calves) for the production of cheese. Production takes place in fermenters on a 40,000 L scale.

*Pichia pastoris*

*Pichia pastoris* is a methylotrophic yeast (see *Candida boidinii* and *Hansenula polymorpha*). It provides an efficient platform for the production of foreign proteins. Platform elements are available as a kit and it is worldwide used in academia for the production of proteins. Strains have been engineered that can produce complex human N— glycan (yeast glycans are similar but not identical to those found in humans).

*Physcomitrella* spp.

*Physcomitrella* mosses, when grown in suspension culture, have characteristics similar to yeast or other fungal cultures. This genera is becoming an important type of cell for production of plant secondary metabolites, which can be difficult to produce in some other types of cells.

VI. Methods of Producing Steviol Glycosides

Recombinant microorganisms described herein can be used in methods to produce steviol or steviol glycosides. For example, the method can include growing the recombinant microorganism in a culture medium under conditions in which steviol and/or steviol glycoside biosynthesis genes are expressed. The recombinant microorganism may be grown in a fed batch or continuous process. Typically, the recombinant microorganism is grown in a fermentor at a defined temperature(s) for a desired period of time. Depending on the particular microorganism used in the method, other recombinant genes such as isopentenyl biosynthesis genes and terpene synthase and cyclase genes may also be present and expressed. Levels of substrates and intermediates, e.g., isopentenyl diphosphate, dimethylallyl diphosphate, geranylgeranyl diphosphate, kaurene and kaurenoic acid, can be determined by extracting samples from culture media for analysis according to published methods.

After the recombinant microorganism has been grown in culture for the desired period of time, steviol and/or one or more steviol glycosides can then be recovered from the culture using various techniques known in the art. In some embodiments, a permeabilizing agent can be added to aid the feedstock entering into the host and product getting out. For example, a crude lysate of the cultured microorganism can be centrifuged to obtain a supernatant. The resulting supernatant can then be applied to a chromatography column, e.g., a C-18 column, and washed with water to remove hydrophilic compounds, followed by elution of the compound(s) of interest with a solvent such as methanol. The compound(s) can then be further purified by preparative HPLC. See also WO 2009/140394.

The amount of steviol glycoside (e.g., rebaudioside A or rebaudioside D) produced can be from about 1 mg/L to about 2000 mg/L, e.g., about 1 to about 10 mg/L, about 3 to about 10 mg/L, about 5 to about 20 mg/L, about 10 to about 50 mg/L, about 10 to about 100 mg/L, about 25 to about 500 mg/L, about 100 to about 1,500 mg/L, or about 200 to about 1,000 mg/L, at least about 1,000 mg/L, at least about 1,200 mg/L, at least about at least 1,400 mg/L, at least about 1,600 mg/L, at least about 1,800 mg/L, or at least about 2,000 mg/L. In general, longer culture times will lead to greater amounts of product. Thus, the recombinant microorganism can be cultured for from 1 day to 7 days, from 1 day to 5 days, from 3 days to 5 days, about 3 days, about 4 days, or about 5 days.

It will be appreciated that the various genes and modules discussed herein can be present in two or more recombinant microorganisms rather than a single microorganism. When a plurality of recombinant microorganisms is used, they can be grown in a mixed culture to produce steviol and/or steviol glycosides. For example, a first microorganism can comprise one or more biosynthesis genes for producing steviol and null mutations in a first group of endogenous transporters, while a second microorganism comprises steviol glycoside biosynthesis genes and null mutations in a second group of endogenous transporters.

Alternatively, the two or more microorganisms each can be grown in a separate culture medium and the product of the first culture medium, e.g., steviol, can be introduced into second culture medium to be converted into a subsequent intermediate, or into an end product such as rebaudioside A. The product produced by the second, or final microorganism is then recovered. The microorganisms can have the same or a different group of mutations in endogenous transporters. It will also be appreciated that in some embodiments, a recombinant microorganism is grown using nutrient sources other than a culture medium and utilizing a system other than a fermentor.

Steviol glycosides do not necessarily have equivalent performance in different food systems. It is therefore desirable to have the ability to direct the synthesis to steviol glycoside compositions of choice. Recombinant hosts described herein can produce compositions that are selectively enriched for specific steviol glycosides (e.g., rebaudioside D) and have a consistent taste profile. Thus, the recombinant microorganisms described herein can facilitate the production of compositions that are tailored to meet the sweetening profile desired for a given food product and that have a proportion of each steviol glycoside that is consistent from batch to batch. Microorganisms described herein do not produce the undesired plant byproducts found in *Stevia* extracts. Thus, steviol glycoside compositions produced by the recombinant microorganisms described herein are distinguishable from compositions derived from *Stevia* plants.

VII. Steviol Glycosides, Compositions, and Food Products

Steviol glycosides and compositions obtained by the methods disclosed herein can be used to make food products, dietary supplements and sweetener compositions. For example, substantially pure steviol or steviol glycoside such as rebaudioside A or rebaudioside D can be included in food products such as ice cream, carbonated beverages, fruit juices, yogurts, baked goods, chewing gums, hard and soft candies, and sauces. Substantially pure steviol or steviol glycoside can also be included in non-food products such as pharmaceutical products, medicinal products, dietary supplements and nutritional supplements. Substantially pure steviol or steviol glycosides may also be included in animal feed products for both the agriculture industry and the companion animal industry. Alternatively, a mixture of steviol and/or steviol glycosides can be made by culturing recombinant microorganisms separately, each producing a specific steviol or steviol glycoside, recovering the steviol or steviol glycoside in substantially pure form from each microorganism and then combining the compounds to obtain a mixture containing each compound in the desired proportion. The recombinant microorganisms described herein permit more precise and consistent mixtures to be obtained compared to current *Stevia* products. In another alternative, a substantially pure steviol or steviol glycoside can be incorporated into a food product along with other sweeteners, e.g. saccharin, dextrose, sucrose, fructose, erythritol, aspartame, sucralose, monatin, or acesulfame potassium. The weight ratio of steviol or steviol glycoside relative to other sweeteners can be varied as desired to achieve a satisfactory taste in the final food product. See, e.g., U.S. Patent Publication No. 2007/0128311. In some embodiments, the steviol or steviol glycoside may be provided with a flavor (e.g., citrus) as a flavor modulator.

Compositions produced by a recombinant microorganism described herein can be incorporated into food products. For example, a steviol glycoside composition produced by a recombinant microorganism can be incorporated into a food product in an amount ranging from about 20 mg steviol glycoside/kg food product to about 1800 mg steviol glycoside/kg food product on a dry weight basis, depending on the type of steviol glycoside and food product. For example, a steviol glycoside composition produced by a recombinant microorganism can be incorporated into a dessert, cold confectionary (e.g., ice cream), dairy product (e.g., yogurt), or beverage (e.g., a carbonated beverage) such that the food product has a maximum of 500 mg steviol glycoside/kg food on a dry weight basis. A steviol glycoside composition produced by a recombinant microorganism can be incorporated into a baked good (e.g., a biscuit) such that the food product has a maximum of 300 mg steviol glycoside/kg food on a dry weight basis. A steviol glycoside composition produced by a recombinant microorganism can be incorporated into a sauce (e.g., chocolate syrup) or vegetable product (e.g., pickles) such that the food product has a maximum of 1000 mg steviol glycoside/kg food on a dry weight basis. A steviol glycoside composition produced by a recombinant microorganism can be incorporated into a bread such that the food product has a maximum of 160 mg steviol glycoside/kg food on a dry weight basis. A steviol glycoside composition produced by a recombinant microorganism, plant, or plant cell can be incorporated into a hard or soft candy such that the food product has a maximum of 1600 mg steviol glycoside/kg food on a dry weight basis. A steviol glycoside composition produced by a recombinant microorganism, plant, or plant cell can be incorporated into a processed fruit product (e.g., fruit juices, fruit filling, jams, and jellies) such that the food product has a maximum of 1000 mg steviol glycoside/kg food on a dry weight basis.

For example, such a steviol glycoside composition can have from 90-99% rebaudioside A and an undetectable amount of *stevia* plant-derived contaminants, and be incorporated into a food product at from 25-1600 mg/kg, e.g., 100-500 mg/kg, 25-100 mg/kg, 250-1000 mg/kg, 50-500 mg/kg or 500-1000 mg/kg on a dry weight basis.

Such a steviol glycoside composition can be a rebaudioside B-enriched composition having greater than 3% rebaudioside B and be incorporated into the food product such that the amount of rebaudioside B in the product is from 25-1600 mg/kg, e.g., 100-500 mg/kg, 25-100 mg/kg, 250-1000 mg/kg, 50-500 mg/kg or 500-1000 mg/kg on a dry weight basis. Typically, the rebaudioside B-enriched composition has an undetectable amount of *stevia* plant-derived contaminants.

Such a steviol glycoside composition can be a rebaudioside D-enriched composition having greater than 3% rebaudioside D and be incorporated into the food product such that the amount of rebaudioside D in the product is from 25-1600 mg/kg, e.g., 100-500 mg/kg, 25-100 mg/kg, 250-1000 mg/kg, 50-500 mg/kg or 500-1000 mg/kg on a dry weight basis. Typically, the rebaudioside D-enriched composition has an undetectable amount of *stevia* plant-derived contaminants.

Such a steviol glycoside composition can be a rebaudioside E-enriched composition having greater than 3% rebaudioside E and be incorporated into the food product such that the amount of rebaudioside E in the product is from 25-1600 mg/kg, e.g., 100-500 mg/kg, 25-100 mg/kg, 250-1000 mg/kg, 50-500 mg/kg or 500-1000 mg/kg on a dry weight basis. Typically, the rebaudioside E-enriched composition has an undetectable amount of *stevia* plant-derived contaminants.

Such a steviol glycoside composition can be a rebaudioside M-enriched composition having greater than 3% rebaudioside M and be incorporated into the food product such that the amount of rebaudioside M in the product is from 25-1600 mg/kg, e.g., 100-500 mg/kg, 25-100 mg/kg, 250-1000 mg/kg, 50-500 mg/kg or 500-1000 mg/kg on a dry weight basis. Typically, the rebaudioside M-enriched composition has an undetectable amount of *stevia* plant-derived contaminants.

In some embodiments, a substantially pure steviol or steviol glycoside is incorporated into a tabletop sweetener or "cup-for-cup" product. Such products typically are diluted to the appropriate sweetness level with one or more bulking agents, e.g., maltodextrins, known to those skilled in the art. Steviol glycoside compositions enriched for rebaudioside A, rebaudioside B, rebaudioside D, rebaudioside E, or rebaudioside M, can be package in a sachet, for example, at from 10,000 to 30,000 mg steviol glycoside/kg product on a dry weight basis, for tabletop use.

The invention will be further described in the following examples, which do not limit the scope of the invention described in the claims.

EXAMPLES

Example 1

LC-MS Analytical Procedures

LC-MS analyses were performed using an Ultimate 3000 UPLC system (Dionex) fitted with a waters acquity UPLC®BEH shield RP18 column (2.1×50 mm, 1.7 μm particles, 130 Å pore size) connected to a TSQ Quantum Access (ThermoFisher Scientific) triple quadropole mass spectrometer with a heated electrospray ion (HESI) source, unless otherwise indicated. Elution was carried out using a mobile phase of eluent B (MeCN with 0.1% Formic acid) and eluent A (water with 0.1% Formic acid) by increasing the gradient from 25% to 47% B from min. 0.0 to 4.0, increasing 47% to 100% B in min. 4.0 to 5.0, holding 100% B from min. 5.0 to 6.5 re-equilibration. The flow rate was 0.4 ml/min and the column temperature 35° C. The steviol glycosides were detected using SIM (Single Ion Monitoring) with the following m/z-traces.

TABLE 11

MS analytical information for Steviol Glycosides

| Description | Exact Mass | m/z trace | compound (typical $t_R$ in min) |
|---|---|---|---|
| Steviol + 1 Glucose | $[M + H]^+$ 481.2796 $[M + Na]^+$ 503.2615 | 481.2 ± 0.5 503.1 ± 0.5 | 19-SMG (2.29), 13-SMG (3.5) |
| Steviol + 2 Glucose | $[M + Na]^+$ 665.3149 | 665 ± 0.5 | Rubusoside (2.52) Steviol-1,2-bioside (2.92) Steviol-1,3-bioside (2.28) |
| Steviol + 3 Glucose | $[M + Na]^+$ 827.3677 | 827.4 ± 0.5 | 1,2-Stevioside (2.01) 1,3-Stevioside (2.39) Rebaudioside B (2.88) |
| Steviol + 4 Glucose | $[M + Na]^+$ 989.4200 | 989.4 ± 0.5 | Rebaudioside A (2.0) |
| Steviol + 5 Glucose | $[M + Na]^+$ 1151.4728 | 1151.4 ± 0.5 | Rebaudioside D (1.1) |
| Steviol + 6 Glucose | $[M + Na]^+$ 1313.5257 | 1313.5 ± 0.5 | Rebaudioside M (1.3) |

The levels of steviol glycosides were quantified by comparing with calibration curves obtained with authentic standards from LGC Standards. For example, standard solutions of 0.5 to 100 μM Rebaudioside A were typically utilized to construct a calibration curve.

Example 2

Construction of Rebaudioside Producing Yeast Strains

A. Yeast strain EFSC2772 was constructed from a wild type *Saccharomyces cerevisiae* strain containing three auxotrophic modifications, namely the deletions of URA3, LEU2 and HIS3. The wild type strain can be manipulated using standard genetic methods and can be used as a regular diploid or haploid yeast strain. EFSC2772 was converted to a steviol glycoside producing yeast by genomic-integration of four DNA constructs. Each construct contained multiple genes that were introduced into the yeast genome by homologous recombination. Furthermore, construct one and two were assembled by homologous recombination.

The first construct contained eight genes and was inserted in the DPP1 locus and disrupts and partially deletes DPP1 (phosphatase). The DNA inserted contains: the *Ashbya gossypii* TEF promoter expressing the natMX gene (selectable marker) followed by the TEF terminator from *A. gossypii*; Gene Art codon optimized *Stevia rebaudiana* UGT85C2 (GenBank AAR06916.1; SEQ ID NO: 32) expressed from the native yeast GPD1 promoter and followed by the native yeast CYC1 terminator; *S. rebaudiana* CPR-8 (SEQ ID NO: 24) expressed using the native yeast TPI1 promoter followed by the native yeast TDH1 terminator; *Arabidopsis thaliana* Kaurene synthase (similar to GenBank AEE36246.1; SEQ ID NO: 96) expressed from the native yeast PDC1 promoter and followed by the native yeast FBA1 terminator; *Synechococcus* sp. GGPPS (GenBank ABC98596.1, SEQ ID NO: 97) expressed using the native yeast TEF2 promoter and followed by the native yeast PGI1 terminator; DNA2.0 codon-optimized *S. rebaudiana* KAHe1 (SEQ ID NO: 18), expressed from the native yeast TEF1 promoter and followed by the native yeast ENO2 terminator; *S. rebaudiana* KO-1 (GenBank ABA42921.1, gi 76446107; SEQ ID NO: 98) expressed using the native yeast FBA1 promoter and followed by the native yeast TDH2 terminator; and *Zea mays* truncated CDPS expressed using the native yeast PGK1 promoter and followed by the native yeast ADH2 terminator.

The second construct was inserted at the YPRCΔ15 locus and contained the TEF1 promoter from *A. gossypii* in front of the kanMX gene (selectable marker) followed by the TEF1 terminator from *A. gossypii*, the Gene Art codon optimized *A. thaliana* ATR2 (SEQ ID NO: 99) expressed from the native yeast PGK1 promoter followed by the native yeast ADH2 terminator, *S. rebaudiana* UGT74G1 (GenBank AAR06920.1; SEQ ID NO: 100) expressed from the native yeast TPI1 promoter followed by the native yeast TDH1 terminator, Gene Art codon-optimized *S. rebaudiana* UGT76G1 (GenBank AAR06912; SEQ ID NO: 101) expressed from the native yeast TEF1 promoter followed by the native yeast ENO2 terminator, and GeneArt codon-optimized *S. rebaudiana* UGT91D2e-b which produces a UGT91D2e polypeptide with the amino acid modifications: L211M and V286A, (SEQ ID NO: 54 for UGT91D2e amino acid sequence for the wild type sequence; codon optimized nucleotide sequence is set forth in SEQ ID NO: 102) expressed from the native yeast GPD1 promoter and followed by the native yeast CYC1 terminator.

The first and the second construct were combined in the same spore clone by mating and dissection. This yeast strain was subsequently transformed with construct three and four in two successive events.

Construct three was integrated between genes PRP5 and YBR238C and contained the *Kluyveromyces lactis* LEU2 promoter expressing the *K. lactis* LEU2 gene followed by the LEU2 terminator from *K. lactis*, the native yeast GPD1 promoter expressing the DNA2.0-optimized *S. rebaudiana* KAHe1 (SEQ ID NO: 18) followed by the native yeast CYC1 terminator, and the native yeast TPI1 promoter expressing the *Zea mays* truncated CDPS (SEQ ID NO: 103) followed by the native yeast TPI1 terminator.

Construct four was integrated in the genome between genes ECM3 and YOR093C and contained the TEF promoter from *A. gossypii* expressing the *K. pneumoniae* hphMX gene, followed by the TEF1 terminator from *A. gossypii*; *Synechococcus* sp. GGPPS (SEQ ID NO: 97) expressed from the native yeast GPD1 promoter, followed by the native yeast CYC1 terminator, followed by the native yeast TPI1 promoter expressing the *A. thaliana* Kaurene synthase (SEQ ID NO: 96) followed by the native yeast TPI1 terminator.

The strain was made prototrophic by introduction of the two plasmids p413TEF (CEN/ARS shuttle plasmid with HIS3 marker) and p416-TEF (CEN/ARS shuttle plasmid with URA3 marker) by transformation, and designated EFSC2772.

As evidenced by LC-MS, combined cellular and extracellular product concentrations were between 920-1660 mg/L of RebA and approximately 300-320 mg/L of RebD in two different batches of EFSC2772, approximately 700 mg/L of RebA was detected in the broth when the higher titer results were obtained. Additionally a large peak was seen for RebB, and one skilled in the art will recognize that additional copies of UGT74G1 or upregulation of UGT74G1 will further increase the conversion of RebB to RebA. Conversely, if RebB is the target glycoside, then UGT74G1 can be disrupted or deleted from the chromosome.

B. EFSC2763 yeast strain is derived from a wild type *Saccharomyces cerevisiae* strain containing three auxotrophic modifications, namely the deletions of URA3, LEU2 and HIS3. The genetics of the strain have been stabilized and can be used as a regular diploid or haploid yeast strain. EFSC2763 has been converted to a steviol glycoside producing yeast by genomic-integration of four DNA constructs. Each construct contains multiple genes that were introduced into the yeast genome by homologous recombination. Furthermore, construct one and two were assembled by homologous recombination.

The first construct contains eight genes and is inserted in the DPP1 locus and disrupts and partially deletes DPP1. The DNA inserted contains: the *A. gossypii* TEF promoter expressing the NatMX gene (selectable marker) followed by the TEF terminator from *A. gossypii*; Gene Art codon optimized *S. rebaudiana* UGT85C2 (SEQ ID NO: 32) expressed from the native yeast GPD1 promoter and followed by the native yeast CYC1 terminator; *S. rebaudiana* CPR-8 (SEQ ID NO: 24) expressed using the TPI1 promoter followed by the native yeast TDH1 terminator; *A. thaliana* Kaurene synthase (KS-5; SEQ ID NO: 96) expressed from the PDC1 promoter and followed by the native yeast FBA1 terminator; *Synechococcus* sp. GGPPS (GGPPS-7; SEQ ID NO: 97) expressed using the TEF2 promoter and followed by the native yeast PFI1 terminator; DNA2.0 codon-optimized *S. rebaudiana* KAHe1 (SEQ ID NO: 18), expressed from the TEF1 promoter and followed by the ENO2 terminator; *S. rebaudiana* KO-1 (SEQ ID NO: 98) expressed using the FBA1 promoter and followed by the native yeast TDH2 terminator; and *Zea mays* truncated CDPS (SEQ ID NO: 103) expressed using the PGK1 promoter and followed by the native yeast ADH2 terminator.

The second construct was inserted at the YPRCΔ15 locus and contains the native yeast TEF promoter from *A. gossypii* in front expressing the KanMX gene (selectable marker) followed by the TEF terminator from *A. gossypii*, the Gene Art codon optimized *A. thaliana* ATR2 (SEQ ID NO: 9) expressed from the PGK1 promoter followed by the yeast ADH2 terminator, *S. rebaudiana* UGT74G1 (SEQ ID NO: 100) expressed from the TPI1 promoter followed by the yeast TDH1 terminator, Gene Art codon-optimized *S. rebaudiana* UGT76G1 (SEQ ID NO: 101) expressed from the TEF1 promoter followed by the yeast ENO2 terminator, and GeneArt codon-optimized *S. rebaudiana* UGT91D2e-b (SEQ ID NO: 102) expressed from the GPD1 promoter and followed by the yeast CYC1 terminator.

The first and the second construct were combined in the same spore clone by mating and dissection. This yeast strain was subsequently transformed with construct three and four in two successive events.

Construct three was integrated between genes PRP5 and YBR238C and contained the TEF promoter from *A. gossypii* expressing the *K. lactis* LEU2 gene followed by the TEF terminator from *A. gossypii*, the GPD1 promoter expressing the DNA2.0-optimized *S. rebaudiana* KAHe1 (SEQ ID NO: 18) followed by the CYC1 terminator, and the TPI1 promoter expressing the *Zea mays* truncated CDPS (SEQ ID NO: 103).

Construct four was integrated in the genome between genes ECM3 and YOR093C with an expression cassette containing the TEF promoter from *A. gossypii* expressing the *K. pneumoniae* hph gene (SEQ ID NO: 157; see Gritz et al., (1983) *Gene* 25:179-88) followed by the TEF terminator from *A. gossypii*, *Synechococcus* sp. GGPPS expressed from the GPD1 promoter followed by the CYC1 terminator, and the TPI1 promoter expressing the *A. thaliana* Kaurene synthase. The four utilized genetic markers were subsequently removed.

As analyzed by LC-MS following the DMSO-extraction of total steviol glycosides from cells and broth, EFSC2763 produces between 40-50 μM or 2-3 μM/OD600 Rebaudioside A, after growth for four days in 3 ml SC (Synthetic Complete) media at 30° C. with 320 RPM shaking in deep-well plates.

C. Strain EFSC2797 was created from strain EFSC2763 by the addition of one more assembly construct at the YORW locus. The additional construct is as follows. The *A. gossypii* TEF promoter expressing the HIS gene (selectable marker) from *S. pombe* followed by the TEF terminator from *A. gossypii*; *S. rebaudiana* KO-1 (SEQ ID NO: 98) expressed using the GPD1 promoter and followed by the native yeast tCYC1 terminator; *S. rebaudiana* CPR-8 (SEQ ID NO: 24) expressed using the TPI1 promoter followed by the native yeast TDH1 terminator; *A. thaliana* Kaurene synthase (KS-5; SEQ ID NO: 96) expressed from the PDC1 promoter and followed by the native yeast FBA1 terminator; *Oryza sativa* EUGT11 (SEQ ID NO: 53) expressed from the TEF2 promoter followed by the yeast PGI1 terminator; DNA2.0 codon-optimized *S. rebaudiana* KAHe1 (SEQ ID NO: 18) expressed from the TEF1 promoter and followed by the ENO2 terminator; *Zea mays* truncated CDPS (SEQ ID NO: 103) expressed from the PGK1 promoter and followed by the ADH2 terminator.

LC-MS analysis following the DMSO-extraction of total steviol glycosides from cells (cells grown in 24-well plates for 4 days at 30° C.) and broth demonstrated that EFSC2797 produces varying amounts of RebA, RebB, RebD, RebM and Rubusoside, see Table 12 below.

TABLE 12

Steviol glycoside production from EFSC2797

| Rubu (μM/OD600) | RebB (μM/OD600) | RebA (μM/OD600) | RebD (μM/OD600) | RebM (μM/OD600) | Normalized by OD600 |
|---|---|---|---|---|---|
| 0.110 | 0.634 | 3.364 | 3.451 | 5.411 | Average |
| 0.065 | 0.263 | 1.119 | 1.222 | 1.614 | Std Deviation |

| Rubu (μM) | RebB (μM) | RebA (μM) | RebD (μM) | RebM (μM) | |
|---|---|---|---|---|---|
| 1.349 | 8.477 | 46.737 | 47.691 | 75.952 | Average |
| 0.0611 | 2.2025 | 16.7505 | 17.1447 | 28.1131 | Std Deviation |

D. EFSC3248 yeast strain was derived from the same parent wild type *Saccharomyces cerevisiae* strain described above and the following genes described in Table 13 were integrated using methods similar to the above. In addition this strain is HO— to prevent switching in mating types.

TABLE 13

List of Recombinant Pathway Genes and Promoters used in Strain EFSC 3248.

| Heterologous pathway gene | Number of copies | Promoter(s) used |
|---|---|---|
| GGPPS7 (*Synechococcus* sp) synthetic (SEQ ID NO: 97) | 1 | TEF2 |
| CDPS (truncated, *Zea mays*) native gene (SEQ ID NO: 103) | 2 | PGK1 X 2 |
| KS5 (*A. thaliana*) native gene (SEQ ID NO: 96) | 2 | PDC1 X 2 |
| KO-1 (*S. rebaudiana* KO1) synthetic gene (SEQ ID NO: 98) | 2 | FBA1, GPD1 |
| ATR2 synthetic gene (SEQ ID NO: 99) | 1 | PGK1 |
| KAH (*S. rebaudiana* KAHe1) synthetic gene (SEQ ID NO: 18) | 2 | TEF1 X 2 |
| *S. rebaudiana* CPR 8 native gene (SEQ ID NO: 24) | 2 | TPI1 X 2 |
| UGT85C2 (*S. rebaudiana*) synthetic (SEQ ID NO: 32) | 1 | GPD1 |
| UGT74G1 native (*S. rebaudiana*) (SEQ ID NO: 100) | 1 | TPI1 |
| UGT76G1 synthetic (*S. rebaudiana*) (SEQ ID NO: 101) | 1 | TEF1 |
| 91D2e-b 2X mutant, synthetic, from *S. rebaudiana* (SEQ ID NO: 102) | 1 | GPD1 |
| EUGT11 synthetic (*Oryza sativa*) (SEQ ID NO: 53) | 1 | TEF2 |

Example 3

Construction of Yeast Strains Overexpressing Transporters

Yeast strains that produce Rebaudiosides are described in Example 2 above, and International Application No's.: PCT/US2011/038967 (WO/2011/153378) and PCT/US2012/050021 (WO/2013/022989) both incorporated by reference herein in their entirety. Observations from shake flask studies of similar strains indicated that the fraction of RebA in the supernatant increases with time, and the effect was determined not to be the result of cell lysis. To determine the effect of various transporters on steviol glycoside excretion in *Saccharomyces cerevisiae*, a library of *Saccharomyces cerevisiae* strains was constructed by substituting the TEFL constitutive promoter for the endogenous promoter for a transporter gene.

A cassette was constructed consisting of the TEF promoter and the HIS5 (*Schizosaccharomyces pombe*) marker flanked by lox P sites. Primers with specific tails were used for PCR amplification of the cassette and the product was integrated upstream from the gene of interest by homologous recombination in the RebA producer EFSC2763 described above. A Kosak sequence was added to the primer tails that anneal to the start of the gene so it was positioned just in front of the start codon. Correct insertion of the cassette was confirmed by PCR using a forward primer annealing to the TEF1 promoter and a gene specific reverse primer annealing to the specific transporter genes. Table 14 contains a list of 44 transport related genes where the TEF1 constitutive promoter was used to replace the endogenous promoter.

TABLE 14

Transport related genes (UniProtKB/Swiss-Prot numbering)

| | Gene | ORF | Accession no. |
|---|---|---|---|
| 1 | PDR1 | YGL013C | P12383 (SEQ ID NO: 104) |
| 2 | PDR3 | YBL005W | P33200 (SEQ ID NO: 105) |
| 3 | PDR8 | YLR266C | Q06149 (SEQ ID NO: 106) |
| 4 | PDR5 | YOR153W | P33302 (SEQ ID NO: 107) |
| 5 | PDR10 | YOR328 | P51533 (SEQ ID NO: 108) |
| 6 | PDR11 | YIL013 | P40550 (SEQ ID NO: 109) |
| 7 | PDR12 | YPL058 | Q02785 (SEQ ID NO: 110) |
| 8 | PDR15 | YDR406 | Q04182 (SEQ ID NO: 111) |
| 9 | PDR18 | YNR070w | P53756 (SEQ ID NO: 112) |
| 10 | SNQ2 | YOR328 | P32568 (SEQ ID NO: 113) |
| 11 | STE6 | YKL209c | P12866 (SEQ ID NO: 114) |
| 12 | YOR1 | YGR281 | P53049 (SEQ ID NO: 115) |
| 13 | AUS1 | YOR011W | Q08409 (SEQ ID NO: 116) |
| 14 | — | YOL075c | Q08234 (SEQ ID NO: 117) |
| 15 | — | YIL166c | P40445 (SEQ ID NO: 118) |
| 16 | THI73 | YLR004c | Q07904 (SEQ ID NO: 119) |
| 17 | NFT1 | YKR103w | P0CE68 (SEQ ID NO: 120) |
| 18 | ADP1 | YCR011C | P25371 (SEQ ID NO: 121) |
| 19 | FLR1 | YBR008C | P38124 (SEQ ID NO: 122) |
| 20 | QDR1 | YIL120W | P40475 (SEQ ID NO: 123) |
| 21 | QDR2 | YIL121W | P40474 (SEQ ID NO: 124) |
| 22 | QDR3 | YBR043C | P38227 (SEQ ID NO: 125) |
| 23 | TPO1 | YLL028W | Q07824 (SEQ ID NO: 126) |
| 24 | TPO2 | YGR138C | P53283 (SEQ ID NO: 127) |
| 25 | TPO3 | YPR156c | Q06451 (SEQ ID NO: 128) |
| 26 | TPO4 | YOR273C | Q12256 (SEQ ID NO: 129) |
| 27 | AQR1 | YNL065W | P53943 (SEQ ID NO: 130) |

TABLE 14-continued

Transport related genes (UniProtKB/Swiss-Prot numbering)

| | Gene | ORF | Accession no. |
|---|---|---|---|
| 28 | AZR1 | YGR224W | P50080 (SEQ ID NO: 131) |
| 29 | SGE1 | YPR198W | P33335 (SEQ ID NO: 132) |
| 30 | YHK8 | YHR048W | P38776 (SEQ ID NO: 133) |
| 31 | ATR1 | YML116W | P13090 (SEQ ID NO: 134) |
| 32 | GEX2 | YKR106W | P36173 (SEQ ID NO: 135) |
| 33 | HOL1 | YNR055C | P53389 (SEQ ID NO: 136) |
| 34 | — | YOR378W | Q08902 (SEQ ID NO: 137) |
| 35 | — | YMR279C | Q03263 (SEQ ID NO: 138) |
| 36 | ENB1 | YOL158C | Q08299 (SEQ ID NO: 139) |
| 37 | ARN1 | YHL040C | P38731 (SEQ ID NO: 140) |
| 38 | ARN2 | YHL047C | P38724 (SEQ ID NO: 141) |
| 39 | SSU1 | YPL092W | P41930 (SEQ ID NO: 142) |
| 40 | THI7 | YLR237W | Q05998 (SEQ ID NO: 143) |
| 41 | TPN1 | YGL186C | P53099 (SEQ ID NO: 144) |
| 42 | SEO1 | YAL067C | P39709 (SEQ ID NO: 145) |
| 43 | SIT1 | YEL065W | P39980 (SEQ ID NO: 146) |
| 44 | DTR1 | YBR180W | P38125 (SEQ ID NO: 147) |

The 44 strains were tested for RebA excretion. Duplicate cultures were incubated in 3 ml synthetic complete (SC) medium for 48 hours (30° C., 310 rpm, 24 well plates). Supernatant samples were obtained by centrifugation of 100 µl of the culture (4000 rcf, 7 min). Twenty-five µl of the supernatant was added to the double amount of 50% DMSO.

Figure 2:
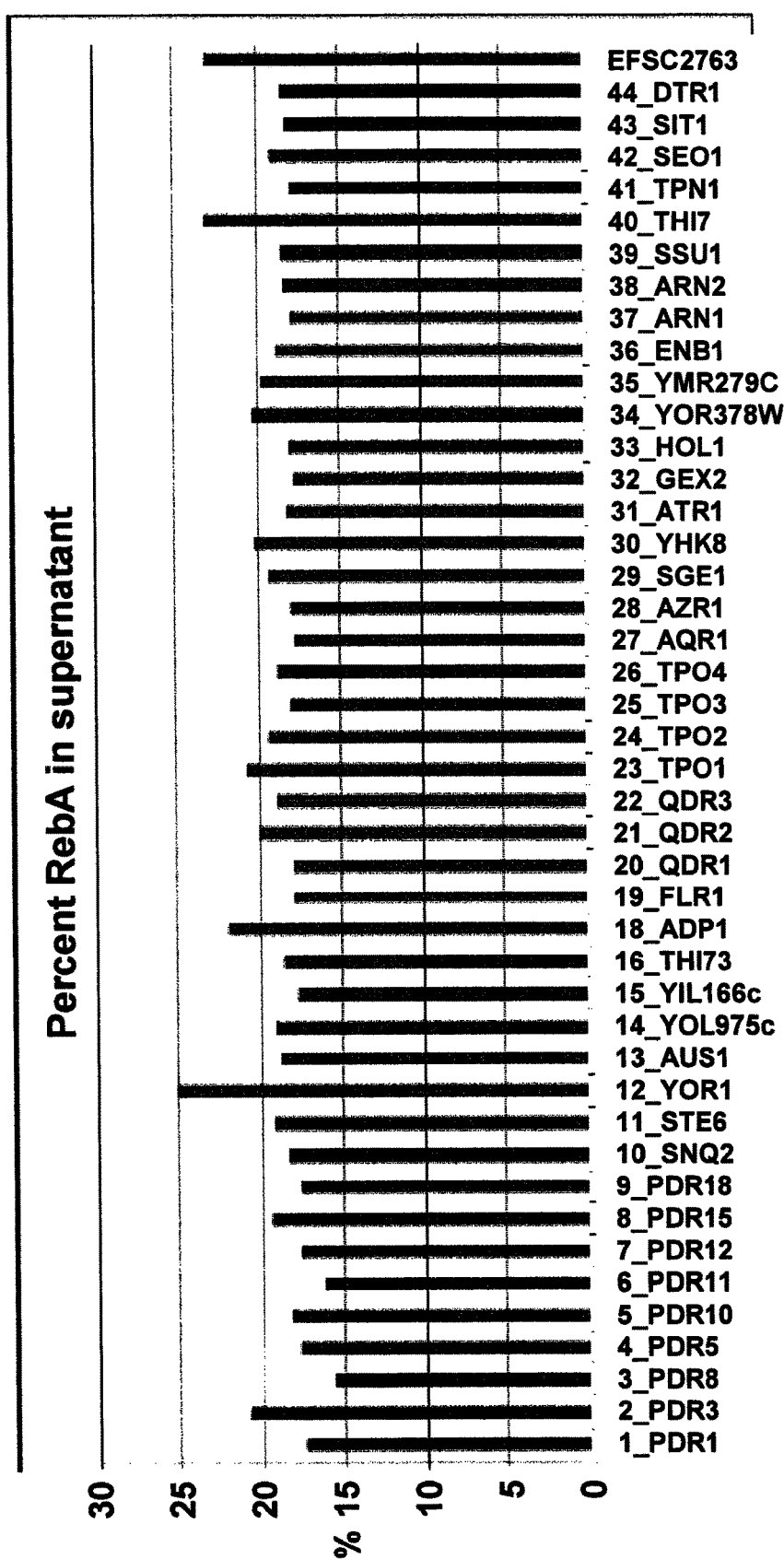
FIG. 2 is a bar graph of the percent RebA in the supernatant of cultures from RebA-producing yeast strains overexpressing transporter genes. The native transporter promoters were replaced by the strong constitutive promoter TEFL by homologous recombination. The strains were grown in synthetic complete (SC) medium for 48 hours and the RebA content was measured in the pellet and the supernatant fraction by LC-MS.

These samples were analyzed by LC-MS as supernatant (cell-free) samples. The LC-MS method utilized was similar to Example 1 except a Phenomenex® kinetex C18 column (150×2.1 mm, 2.6 µm particles, 100 Å pore size) was utilized, and a more shallow gradient was employed from 40-50% B, resulting in typically longer retention times. The remaining supernatant from the original sample was removed and the pellet washed in 100 µl water. The pellet was resuspended in 100 µl 50% DMSO and heated to 80° C. for 10 minutes before the sample was centrifuged (4000 rcf, 5 min). Twenty-five µl of supernatant obtained from the resuspended pellet was added to an equal amount of 50% DMSO and an equal amount of water before transferring the sample to a filter plate. The samples were harvested from the filter plate (2000 rcf, 2 min) and measured on the LC-MS as pellet samples. Results are shown in FIG. 2.

Figure 3:
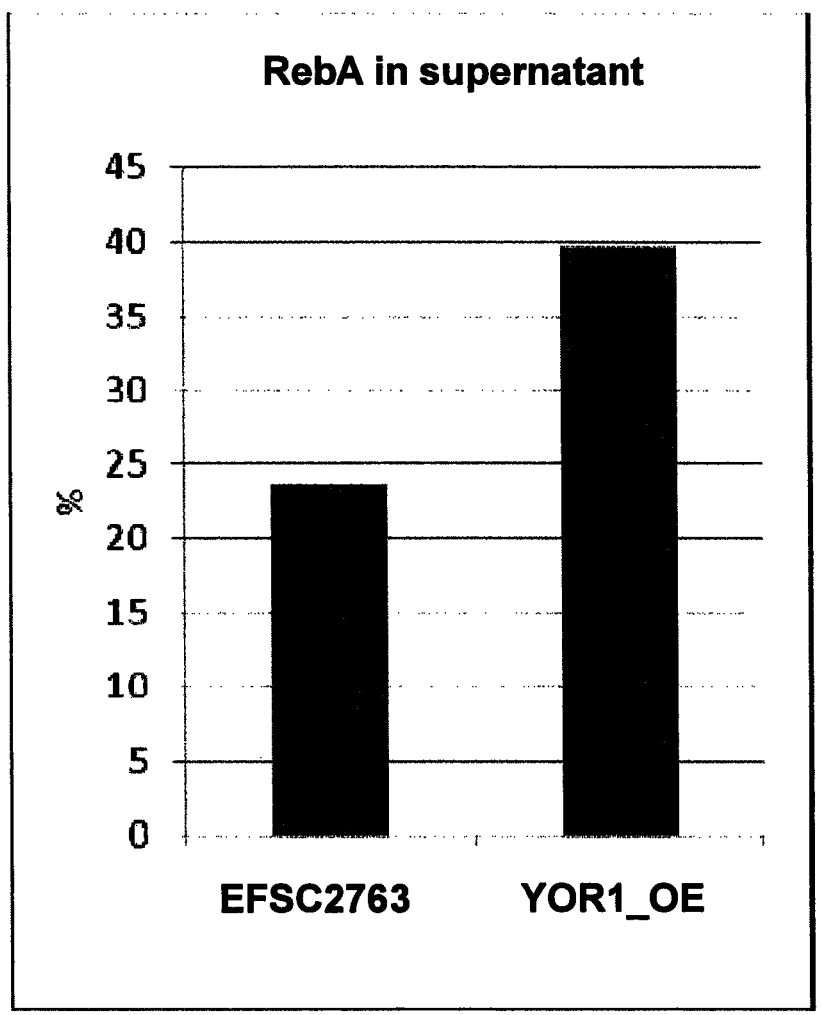
FIG. 3 is a bar graph of the percent RebA in the supernatant of the YOR1 overexpressing yeast strain compared to a wild type strain with a native promoter in front of the YOR1 gene. The RebA content was measured in the pellet and the supernatant fraction by LC-MS.

Strain "12_YOR1" showed a higher percentage of RebA in the pellet than in the pellet as compared to the EFSC2763 control strain. The "18_ADP1" and "EFSC2763" strains produced less RebA in total than the other strains and "40_THI7" had a large deviation between samples. The YOR1 overexpressing strain was tested again. In the second experiment, the YOR1 overexpressing strain "YOR1_OE" produced less total RebA than the EFSC2763 control strain, but still showed a higher percentage of RebA in the supernatant than the control strain (FIG. 3). Messenger RNA levels were measured for the candidate transporters, and in many cases expression levels were not increased substantially from wild type levels.

Nine candidates (PDR1, PDR3, PDR13, SNQ2, YOR1_BY, YOR1_IS1, FLR1, AZR1 and DTR1) were re-tested for rebaudioside production and excretion in another producing strain, EFSC2797 (described above), and on a 2 micron plasmid (PSB314). Duplicate cultures were incubated in 3 ml synthetic complete (SC) medium for 48 hours (30° C., 310 rpm, 24 well plates). Supernatant samples were obtained by centrifugation of 100 µl of the culture (13,000 rcf, 5 min). Fifty microliters of the supernatant was added to an equal amount of 100% DMSO. These samples were analyzed by LC-MS as supernatant samples. A total broth sample was mixed with an equal volume of 100% DMSO and heated to 80° C. for 10 minutes before the sample was centrifuged (4000 rcf, 5 min), and the liquid portion was analyzed by LC-MS as "total" steviol glycoside levels. The amount of various steviol glycosides (including RebA, RebB, RebD, RebM, Rubusoside, 13-SMG, 1.2 Stevioside, 1.2 Bioside and an unknown steviol glycoside (LC-MS peak at 4.13 min.)) excreted into the culture supernatant as well as the total amount in the whole culture broth were measured by LC-MS as described in Example 1. Results are seen in FIG. 4 A-M. The percentage plotted for excretion is for the supernatant value divided by the "total" amount in FIGS. 4A-K or the concentration in micromolar per OD600 was also plotted (FIGS. 4J-K) or the concentration in the supernatant or total was plotted (FIGS. 4L-M).

Independent overexpression of each nine candidate genes (PDR1, PDR3, PDR13, SNQ2, YOR1_BY, YOR1_IS1, FLR1, AZR1 and DTR1) demonstrated that various steviol glycosides were excreted at a higher percentage and/or concentration in the supernatant compared to the control strain (the control is EFSC2797 with empty PSB314 plasmid; shown as "PSB314" in FIG. 4 A-M). YOR1_BY (SEQ ID NO: 148) represents the DNA sequence of YOR1 gene that has been amplified from the BY 4741 genomic DNA and cloned in 2 micron plasmid containing URA auxotrophic marker (P426-GPD); YOR1_IS1 (SEQ ID NO: 149) represents the DNA sequence of YOR1 gene has been amplified from an additional wildtype Saccharomyces cerevisiae genomic DNA and cloned in 2 micron plasmid containing URA auxotrophic marker (P426-GPD). For example, strain "SNQ2" showed a higher percentage of RebA, RebB, RebD, RebM, 1.2 Stevioside, 1.2 Bioside and the unknown steviol glycoside at 4.13 min in the supernatant while the total production is the same compared to the EFSC2797 control strain with empty PSB314 plasmid (shown as "PSB314" or "Empty Plasmid" in FIGS. 4-6). Strain "YOR1_IS1" showed a higher percentage of RebB, RebD, Rubusoside, 1.2 Stevioside, 1.2 Bioside and the unknown steviol glycoside at 4.13 min in the supernatant than in the total sample as compared to the EFSC2797 control strain. Furthermore, SNQ2 and YOR1 overexpression demonstrated an increase in concentration of RebD and RebA in the supernatant compared to the control (see FIG. 4 J-M).

Four of the nine candidates above were tested again for rebaudioside production and excretion in the producing EFSC2797 strain, and using the PSB314 2 micron plasmid to overexpress the transporters. Cultures were incubated in 3 ml synthetic complete (SC) medium—URA (selection pressure) for 72 hours (30° C., 310 rpm, 24 well plates). Supernatant samples were obtained by centrifugation of 100 µl of the culture (13,000 rcf, 5 min). Fifty microliters of the supernatant was added to 50 ul of 100% DMSO. These samples were anaylzed by LC-MS as supernatant samples. 50 µl of cell suspension were mixed with 50 µl of 100% DMSO and heated to 80° C. for 10 minutes before the sample was centrifuged (4000 rcf, 5 min); the liquid portion was measured on the LC-MS as "total" samples. The amount of various steviol glycosides (including RebA, RebB, RebD, RebM, Rubusoside, 13-SMG, 1.2 Stevioside, 1.2 Bioside and an unknown steviol glycoside (LC-MS peak at 4.13 min.)) excreted into the culture supernatant as well as the total amount in the whole culture broth were measured by LC-MS as described in Example 1. The area under the curve (AUC) is determined by integration during data processing using Xcalibur software (Thermo). Results showing amount excreted (AUC) are seen in FIG. 5 A-D and results show percent excreted in supernatant (ratio of supernatant/total value) are shown in FIG. 5E-I.

Figure 5:
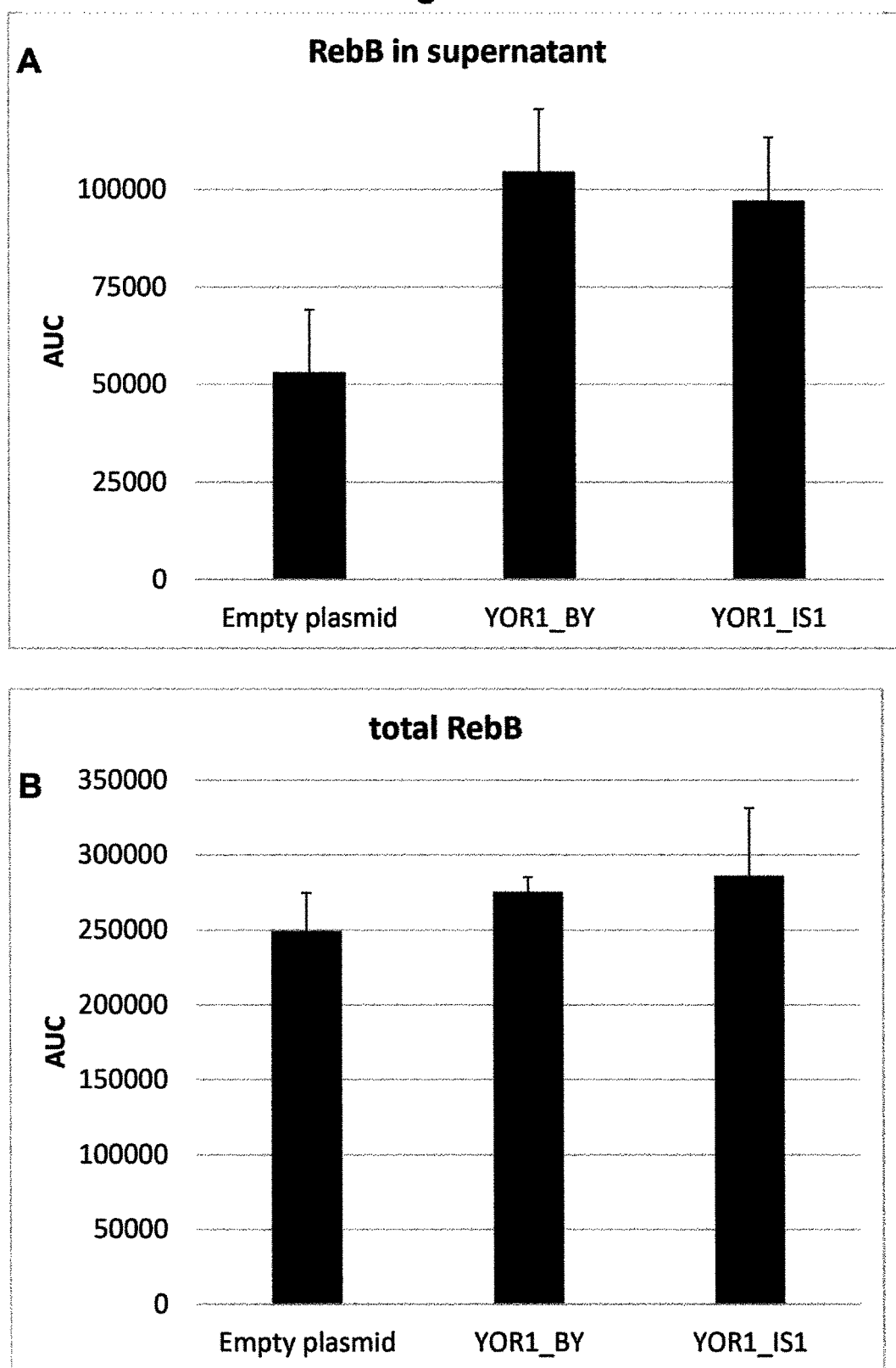
FIG. 5A-I is a bar graph of the amount (AUC in FIG. 5A-D) or percent of each steviol glycocoside excreted (FIG. 5E-I) in the supernatant of endogenous yeast transporter genes PDR1, SNQ2, YOR1_BY, YOR1_IS1 and FLR1 overexpressed using PSB314 in the yeast strain EFSC2797 compared to a control strain (PSB314). Endogenous yeast transporter genes PDR1, SNQ2, YOR1_BY, YOR1_IS1 and FLR1 were overexpressed using the PSB314 plasmid in the ERSC2797 Reb producing strain and the content of each steviol glycoside was measured in the pellet and the supernatant fraction by LC-MS.
Figure 5:
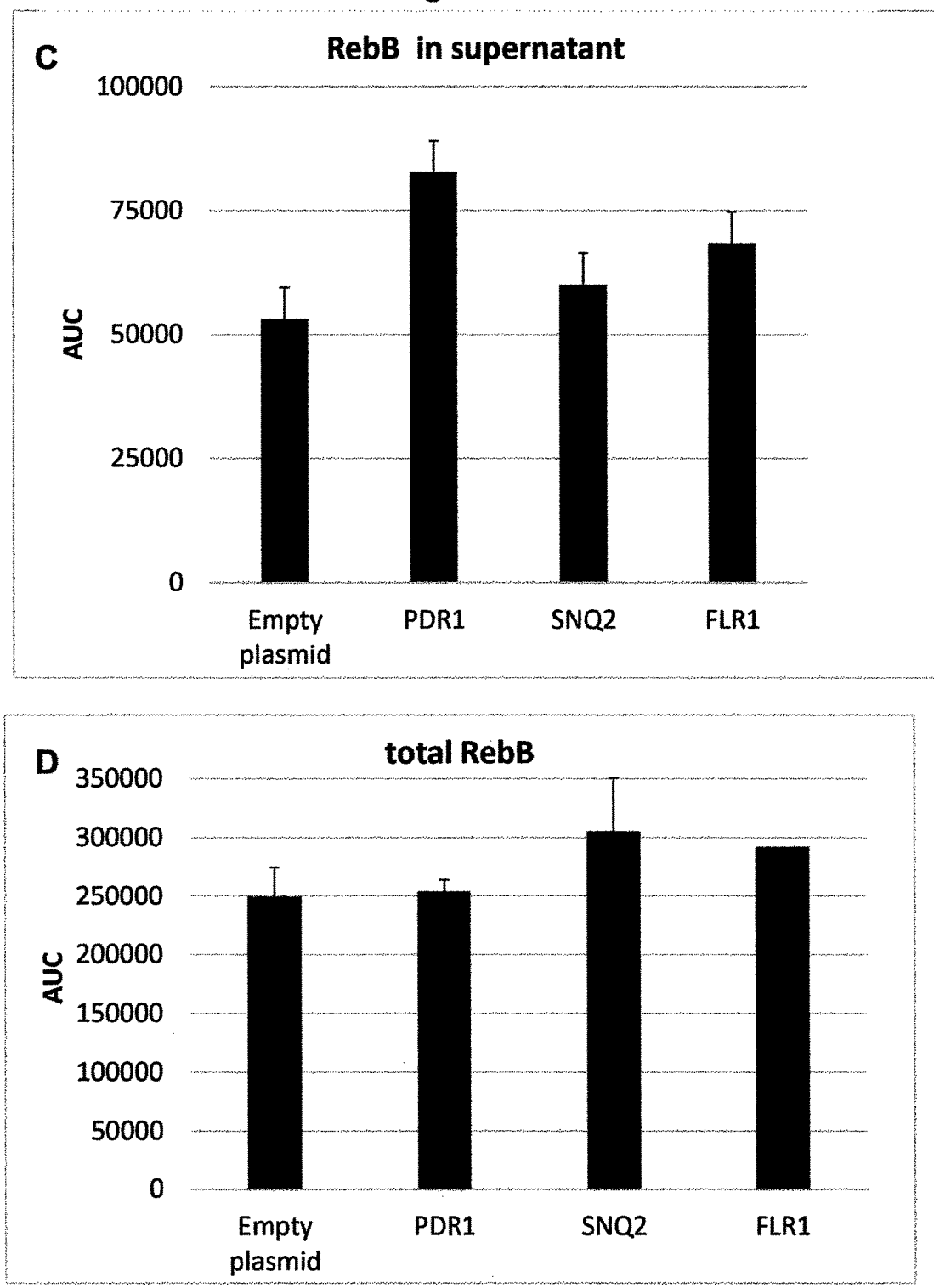
Figure 5:
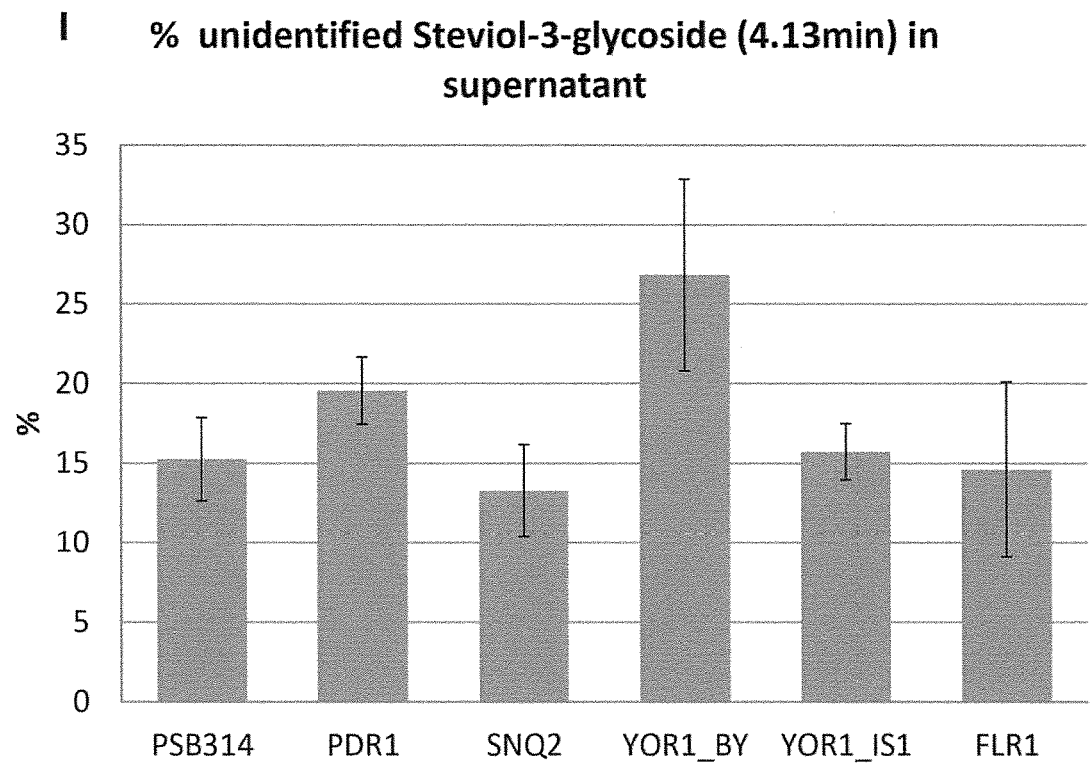
Figure 6:
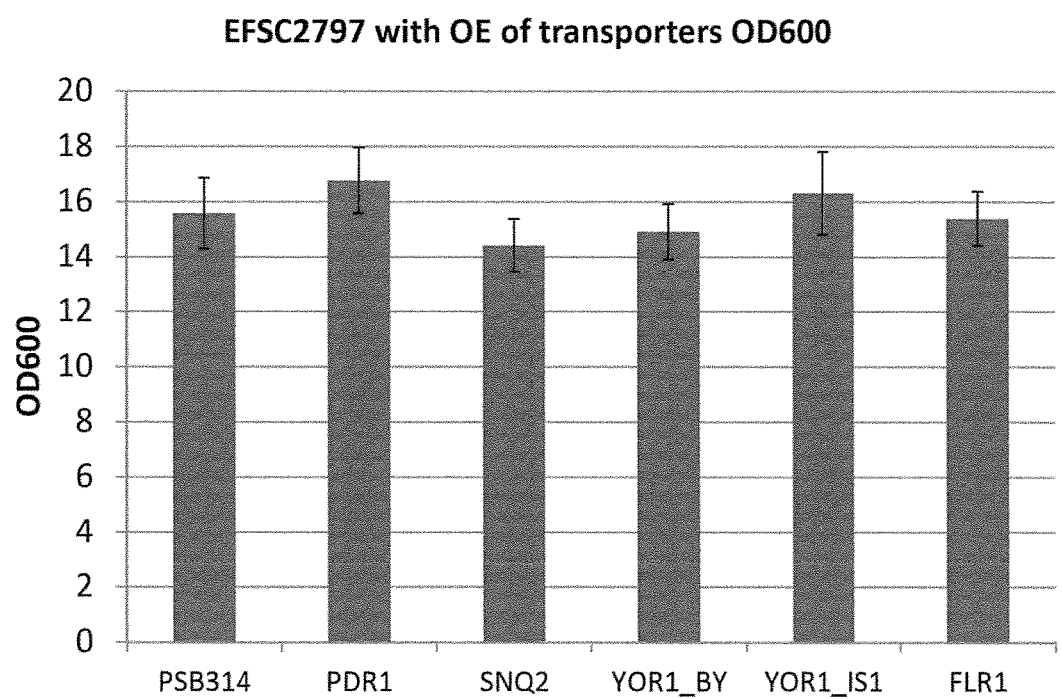
FIG. 6 is a bar graph illustrating the effect on yeast growth from overexpressing endogenous yeast transporter genes PDR1, SNQ2, YOR1_BY, YOR1_IS1 and FLR1 in the yeast ERSC2797 strain.

Overexpression of each the four candidate genes separately (PDR1, SNQ2, YOR1_BY, YOR1_IS1 and FLR1) demonstrated that various steviol glycosides were excreted at a higher percentage and/or concentration in the supernatant compared to the control strain (EFSC2797 with empty PSB314 plasmid; shown as "PSB314" in FIG. 5 A-I). For example, strain "YOR1_BY" and "YOR1_IS1" both showed a higher percentage of RebA, RebB, 1.2 Stevioside and the unknown steviol glycoside at 4.13 min in the supernatant than in the total as compared to the EFSC2797 control strain. Furthermore, SNQ2, YOR1, PDR1 and FLR1 overexpressed separately demonstrated an increase in AUC of RebB in the supernatant compared to the control (see FIG. 5 A-D). Overexpression of each the four candidate genes separately did not significantly alter the growth rate as measured by OD600 of the EFSC2797 yeast strain compared to control (see FIG. 6).

Example 4

Yeast Strains Overexpressing Stevia Transporters

Figure 7:
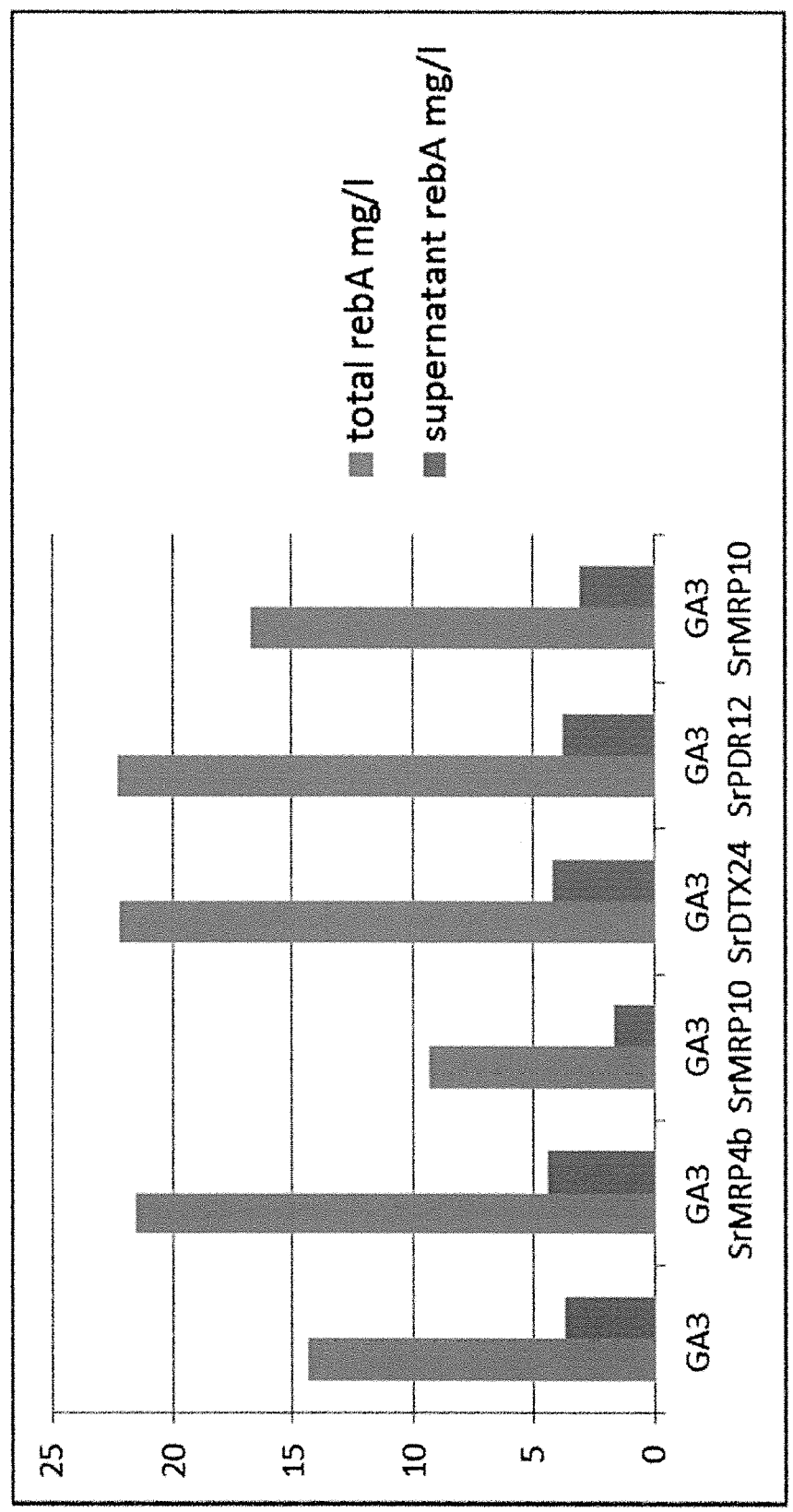
FIG. 7 is a bar graph illustrating the effect of expressing S. rebaudiana transporters in RebA producing strains.

Six putative S. rebaudiana RebA transporters were identified in pyrosequencing data: SrDTX24 (SEQ ID NO: 150), SrMRP10 (SEQ ID NO: 151), SrPDR12 (SEQ ID NO: 152), SrMRP2 (SEQ ID NO: 153), SrMRP4a (SEQ ID NO: 154), and SrMRP4b (SEQ ID NO: 155). Five of the putative transporters, SrDTX24, SrMRP10, SrPDR12, SrMRP4a and SrMRP4b, were chosen for further study and cloned. The cloned transporter sequences were expressed in a stable RebA-producing S. cerevisiae. The levels of steviol-glycoside excretion were measured and are shown in FIG. 7.

Example 5

Method for Identifying Rebaudioside Transporters in Yeast

Construction of Quadruple Transporter Mutant Yeast Strain

Yeast strains that produce Rebaudiosides are described in Example 2 above, and International Application No's.: PCT/US2011/038967 (WO/2011/153378) and PCT/US2012/050021 (WO/2013/022989) both incorporated by reference herein in their entirety. Observations from shake flask studies of similar strains indicated that steviol glycosides were excreted from S. cerevisiae cells with an efficiency that appeared to decrease as the molecular weight of the molecule increased. To determine the effect of various transporters on steviol glycoside excretion in S. cerevisiae, a library of S. cerevisiae mutants, each carrying a disruption in an endogenous transporter, was constructed.

Plasma membrane-located ABC and MFS transporters were singly disrupted in S. cerevisiae strains BY4741 and/or BY4742 (BY4741 is available as ATCC 201388, and BY4742 is available as ATCC 201389; see Brachmann, et al. "Designer deletion strains derived from Saccharomyces cerevisiae S288C: a useful set of strains and plasmids for PCR-mediated gene disruption and other applications." Yeast 14:115-32, 1998), using an antibiotic marker cassette amplified with primers having 45-65 bp gene specific longtails. The cassettes were transformed into the strains and specific transporter genes were disrupted by homologous recombination of the antibiotic marker cassette. Disruption of native transporter genes was confirmed by PCR, using a forward primer specific to the upstream sequence of the native gene and a reverse primer located internally in the antibiotic marker cassette. The mutant library encompassed a total of 34 transporters (14 ABCs, 19 MFSs, and 1 other) and two transcription factors. See Table 15.

TABLE 15

Transport-related genes knocked out to create yeast mutants in laboratory strains

| | Name | ORF | Type/Location of protein | Accession No.* |
|---|---|---|---|---|
| | PDR1/3 | YGL013C/ YBL005W | Transcription factor | P12383/(SEQ ID NO: 104) P33200 (SEQ ID NO: 105) |
| | PDR3 | YBL005W | Transcription factor | P33200 (SEQ ID NO: 105) |
| 1 | PDR11 | YIL013 | Plasma Membrane | P40550 (SEQ ID NO: 109) |
| 2 | PDR15 | YDR406 | Plasma Membrane | Q04182 (SEQ ID NO: 111) |
| 3 | PDR10 | YOR328 | Plasma Membrane | P51533 (SEQ ID NO: 108) |
| 4 | PDR5 | YOR153W | Plasma Membrane | P33302 (SEQ ID NO: 107) |
| 5 | YOR1 | YGR281 | Plasma Membrane | P53049 (SEQ ID NO: 115) |
| 6 | AUS1 | YOR011W | Mitochondria (Plasma Membrane) | Q08409 (SEQ ID NO: 116) |
| 7 | SNQ2 | YDR011 | Plasma Membrane | P32568 (SEQ ID NO: 113) |
| 8 | PDR12 | YPL058 | Plasma Membrane | Q02785 (SEQ ID NO: 110) |
| 9 | STE6 | YKL209c | Plasma Membrane | P12866 (SEQ ID NO: 114) |
| 10 | — | YOL075c | (Membrane) | Q08234 (SEQ ID NO: 117) |
| 11 | — | YIL166c | (Membrane) | P40445 (SEQ ID NO: 118) |
| 12 | THI73 | YLR004c | (Plasma/ER membrane) | Q07904 (SEQ ID NO: 119) |
| 13 | NFT1 | YKR103w/ YKR104w | Membrane | P0CE68 (SEQ ID NO: 120) |
| 14 | PDR18 | YNR070w | (Mitochondria) | P53756 (SEQ ID NO: 112) |
| 15 | FLR1 | YBR008C | Plasma Membrane | P38124 (SEQ ID NO: 122) |
| 16 | QDR1 | YIL120W | Plasma Membrane | P40475 (SEQ ID NO: 123) |
| 17 | QDR2 | YIL121W | Plasma Membrane | P40474 (SEQ ID NO: 124) |
| 18 | QDR3 | YBR043C | Plasma Membrane | P38227 (SEQ ID NO: 125) |
| 19 | DTR1 | YBR180W | (Prospore membrane) | P38125 (SEQ ID NO: 147) |
| 20 | TPO1 | YLL028W | Plasma Membrane | Q07824 (SEQ ID NO: 126) |
| 21 | TPO2 | YGR138C | Plasma Membrane | P53283 (SEQ ID NO: 127) |
| 22 | AQR1 | YNL065W | Plasma Membrane | P53943 (SEQ ID NO: 130) |
| 23 | AZR1 | YGR224W | Plasma Membrane | P50080 (SEQ ID NO: 131) |

TABLE 15-continued

Transport-related genes knocked out to create yeast mutants in laboratory strains

|  | Name | ORF | Type/Location of protein | Accession No.* |
|---|---|---|---|---|
| 24 | ENB1 | YOL158C | Plasma Membrane | Q08299 (SEQ ID NO: 139) |
| 25 | SGE1 | YPR198W | Plasma Membrane | P33335 (SEQ ID NO: 132) |
| 26 | YHK8 | YHR048W | Membrane | P38776 (SEQ ID NO: 133) |
| 27 | GEX2 | YKR106W | Membrane | P36173 (SEQ ID NO: 135) |
| 28 | HOL1 | YNR055C | Plasma Membrane/Mitochondria | P53389 (SEQ ID NO: 136) |
| 29 | TPO4 | YOR273C | Plasma Membrane/(vacuole) | Q12256 (SEQ ID NO: 129) |
| 30 | TPO3 | YPR156c | Plasma Membrane/(vacuole) | Q06451 (SEQ ID NO: 128) |
| 31 | ATR1 | YML116W | Plasma Membrane/(vacuole) | P13090 (SEQ ID NO: 134) |
| 32 | — | YOR378W | — | Q08902 (SEQ ID NO: 137) |
| 33 | — | YMR279C | — | Q03263 (SEQ ID NO: 138) |
| 34 | HXT11 | YOL156W | Plasma Membrane | P54862 (SEQ ID NO: 156) |

*Accession Number as listed at the <uniprot.org/uniprot> website.

The initial analysis showed that among the mutants of these 36 genes, transporters encoded by the yeast PDR5, PDR10, PDR15 and SNQ2 loci had a detectable effect on excretion of steviol glycosides such as 19-SMG and rubusoside into the culture media. Yeast endogenous transporters encoded by the TPO1, TPO3, YOR1, YOL075c, PDR18, and FLR1 loci, as well as the transcription factors encoded by the PDR1 and PDR3 loci, also had a detectable effect on steviol glycoside excretion, although to a lesser extent than that of PDR5, PDR10, PDR15 and SNQ2. Since several transporters were identified that affected excretion of steviol glycosides, no single transporter appears to be solely responsible for excretion of steviol glycosides in yeast.

To determine the effect of disruptions of more than one transporter on steviol glycoside excretion, a quadruple disruption mutant (pdr5, pdr10, pdr15, snq2) was created. Deletion mutant pdr15 (created in a *S. cerevisiae* strain based on BY4742) was transformed with a selection marker deletion cassette prepared from a PCR using primers with PDR10 flanking sequences as tails, allowing homologous recombination upon transformation. In the same way, a snq2 deletion strain was created (based on BY4741) and was transformed with a second selection marker deletion cassette using PDR5 flanking sequences as primer tails. The resulting two double mutant strains (pdr15 pdr10 and snq2-pdr5) were mated to create spore products disrupted in all four transporter genes. Disruptions were verified by PCR using a primer strategy as described for the single disruption mutants, resulting in the formation of a quadruple pdr5, pdr10, pdr15, snq2 disruption mutant, referred to as the 4X disruption mutant.

The 4X disruption mutant was transformed with 2 micron plasmids encoding four *Stevia rebaudiana* UGTs: 76G1, 74G1, 91D2e, and 85C2. See WO 2011/153378A1. A culture of the 4X disruption mutant expressing the four UGTs was pre-grown overnight in 13-ml culture tubes containing 2-3 ml of synthetic complete (SC) medium lacking histidine and uracil. A culture of the parent strain with the UGT plasmids, but wild type at the PDR5, PDR10, PDR15, SNG2 loci, served as the control.

Figure 8:
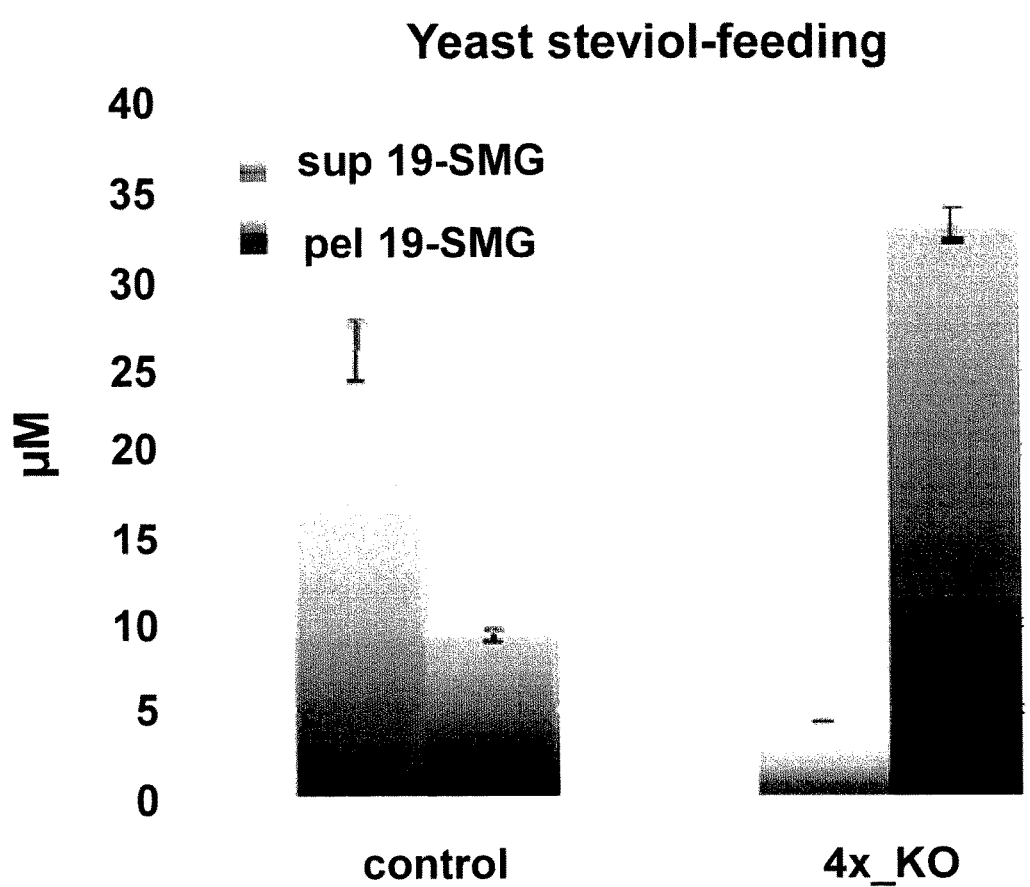
FIG. 8 is a bar graph showing the concentration (micromolar) of steviol-19-O-glucoside produced after a yeast strain carrying mutations at the loci for four endogenous transporters were cultured in steviol-fed media. Sup 19-SMG=Amount of Steviol-19-O-Glucoside in Supernatant; Pel 19-SMG=Amount of Steviol-19-O-Glucoside in Cell Pellet; WT=Wild type expressing four S. rebaudiana UGTs (76G1, 74G1, 91D2e, and 85C2); and 4X KO=4X transporter disruption mutant yeast strain, expressing four S. rebaudiana UGTs and carrying deletions of pdr5, pdr10, pdr15, snq2 transporter loci.

The next day, 0.25 $OD_{600}$ units were spun down, resuspended in fresh medium containing 100 μM steviol, and shaken at 30° C. for 2 h in culture tubes. An aliquot of 100 μL of culture was spun down, and an equal volume of DMSO was added to the supernatant. The cell pellet was washed with $H_2O$ and subsequently resuspended in 200 μL of 50% DMSO. The mixture was then vortexed, heated at 80° C. for 10 minutes and centrifuged to remove debris. The resulting solution (cell pellet sample) was analyzed for the amount of 19-SMG by LC-MS utilizing a method similar to that described in Example 1, except a Phenomenex® kinetex C18 column (150×2.1 mm, 2.6 μm particles, 100 Å pore size) was used, and a more shallow gradient was employed from 40-50% B, resulting in typically longer retention times. The results, shown in FIG. 8, indicate that approximately 90% of the total 19-SMG made by the 4X disruption mutant strain is in the pellet. In contrast, only about 25% of the total 19-SMG made by the wild type strain is in the pellet.

Figure 9:
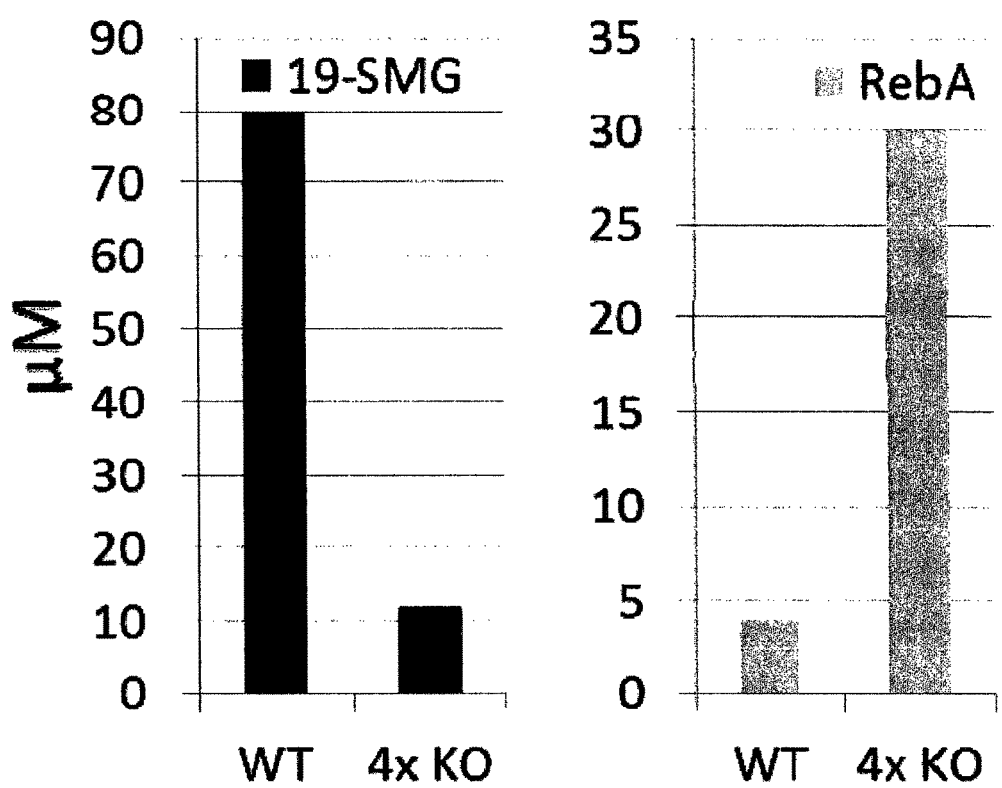
FIG. 9 is a bar graph showing the concentration (micromolar) of 19-SMG and rebaudioside A produced after culture of the 4X transporter disruption yeast strain in steviol-fed media. The amounts shown are the total extracellular (left bar) and intracellular (right bar) 19-SMG and rebaudioside A for each strain.

The 4X disruption mutant strain expressing the four *S. rebaudiana* UGTs was tested for Rebaudioside A production. Pre-cultured cells were concentrated to an $OD_{600}=20$ in 250 μl steviol containing medium (SC-His-Ura, 100 μM steviol). After a 24 hour incubation (at 30° C. and 200 rpm), the cells were harvested. A 100 μL aliquot of the culture was spun down and an equal volume of DMSO was added to the supernatant of this sample. The cell pellet was washed one time in $H_2O$ and 200 μL of 50% DMSO was added to the pellet. Samples were vortexed, heated to 80° C. for 10 minutes and centrifuged. The supernatants from two DMSO mixtures were pooled and steviol glycoside content analyzed by LC-MS utilizing a Phenomenex® kinetex C18 column. The results are shown in FIG. 9. These results indicate that a large increase in RebA accumulation was observed in the 4X mutant strain expressing the four *S. rebaudiana* UGTs as compared to the wild-type strain expressing the four *S. rebaudiana* UGTs. These results suggest that monoglucoside intermediates are less likely to be excreted in the 4X mutant strain and instead serve as substrates for further glycosylation in the cytoplasm of these yeast strains. However, some of the transporters that were knocked out may also have specificity for excretion of larger molecular weight rebaudiosides such as RebA, and may be useful to overexpress in strains where excretion of RebA in the medium is desired. With appropriate balancing of the rate of glycosylation activity through expression of pathway UGTs, smaller molecular weight steviol glycosides are further glycosylated before they are excreted into the medium. For example, higher expression levels of a UGT76G1 and UGT91D2e and/or EUGT11 UGT as compared to the UGT74G1 and UGT85C2 enzymes will prevent accumulation of the steviol monoglucosides that are excreted more readily. If the UGT activity level is higher (so the glycosylation rate is faster) than the rate of transport for a particular steviol glycoside, then more larger molecular weight steviol glycosides will be produced.

Construction of 7X Transporter Mutant Yeast Strain

Based on the quadruple transporter mutant results described above, a 7X transporter disruption mutant (pdr15-pdr10-snq2-pdr5-tpo1-pdr1-pdr3) was generated. A pdr1 and pdr3 double mutant was created in a BY4741 background. The markers used to generate the double mutant were then removed. The resulting double mutant was transformed with a selection marker deletion cassette. The cassette was prepared from PCR using primers with TPO1 flanking sequences as tails allowing homologous recombination upon transformation. The triple mutant pdr1-pdr3-tpo1 was mated with the 4X disruption mutant described above (based on BY4742). In the resulting spores, a strain disrupted in all seven locations was found. Disruption of genes was confirmed by PCR. In the case of cassettes replacing targeted genes, the PCR strategy described above was applied to confirm disruption of genes. For the pdr1 and pdr3 loci, disruptions were confirmed using forward and reverse primers designed to anneal to the sequence upstream and downstream from each gene. PCR products were present in all clones, and short PCR products indicated a loss of the targeted gene.

The four *S. rebaudiana* UGTs described above were integrated into the genome of the 4X and 7X transporter disruption mutants as well as the wild-type strain, using homologous recombination. A steviol-gradient, time-course experiment was performed to investigate the effect on steviol-glycoside accumulation in the wild-type, 4X, and 7X mutant strains. Pre-cultured cells of the 4X and 7X disruption mutant strains, each expressing the four *S. rebaudiana* UGTs, were concentrated to an $OD_{600}=1$ in 400 µl steviol containing medium (SC-Ura, 0 µM, 20 µM, 50 µM, 100 µM, or 250 µM steviol). Strains were grown in a 96 deep well plate at 30° C., 320 rpm, and after approximately 0, 1, 2, 4, 8 or 24 hours of culture, a 50 µL aliquot of each culture was spun down and an equal volume of DMSO was added to the supernatant of each aliquot. Steviol glycoside content was analyzed by LC-MS as described above, with the Phenomenex® kinetex C18 column.

Figure 10:
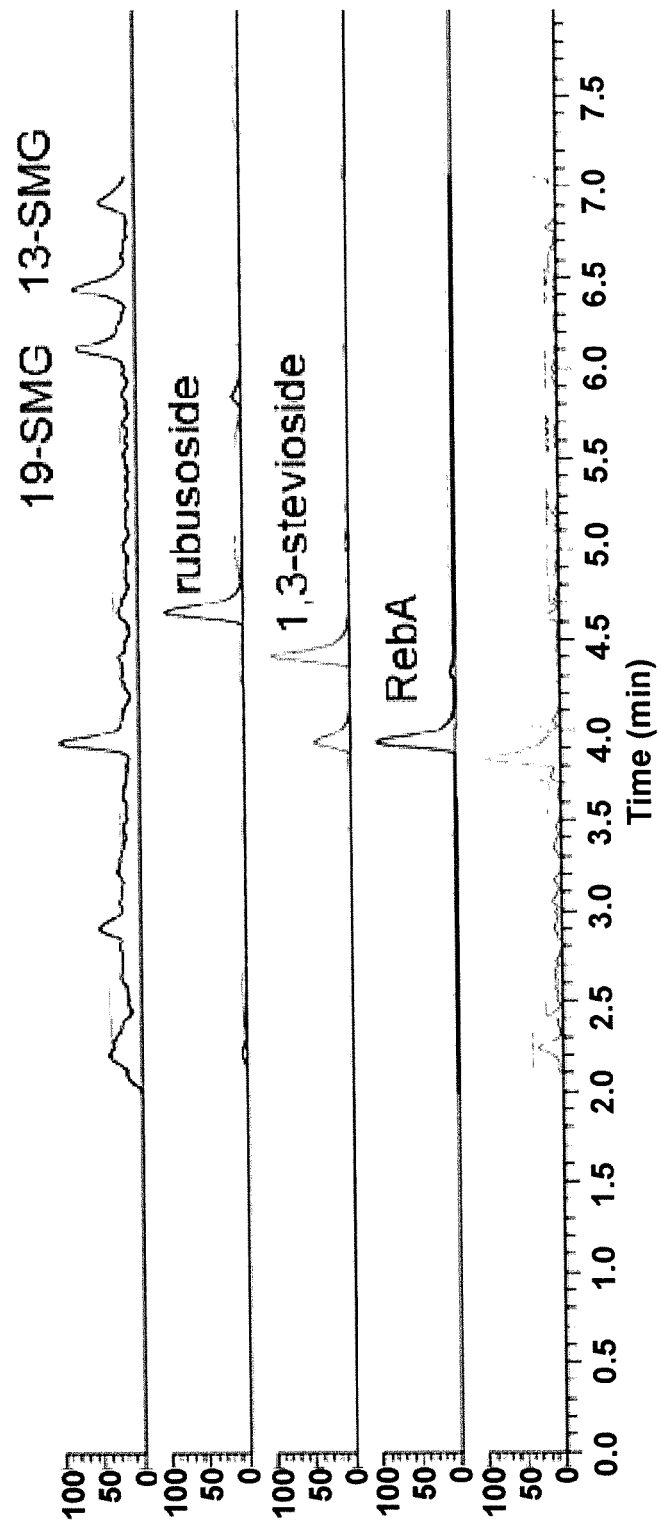
FIG. 10 is a chromatographic trace of steviol glycosides produced by the yeast wild-type strain expressing four S. rebaudiana UGTs (76G1, 74G1, 91D2e, and 85C2). Y-axis=relative amount according to automated scaling in the display. From top to bottom the rows are m/z traces that correspond to monoglucosides, biosides, steviol plus 3 glucose residues, steviol+4 glucose residues, and steviol+5 glucose residues.
Figure 11:
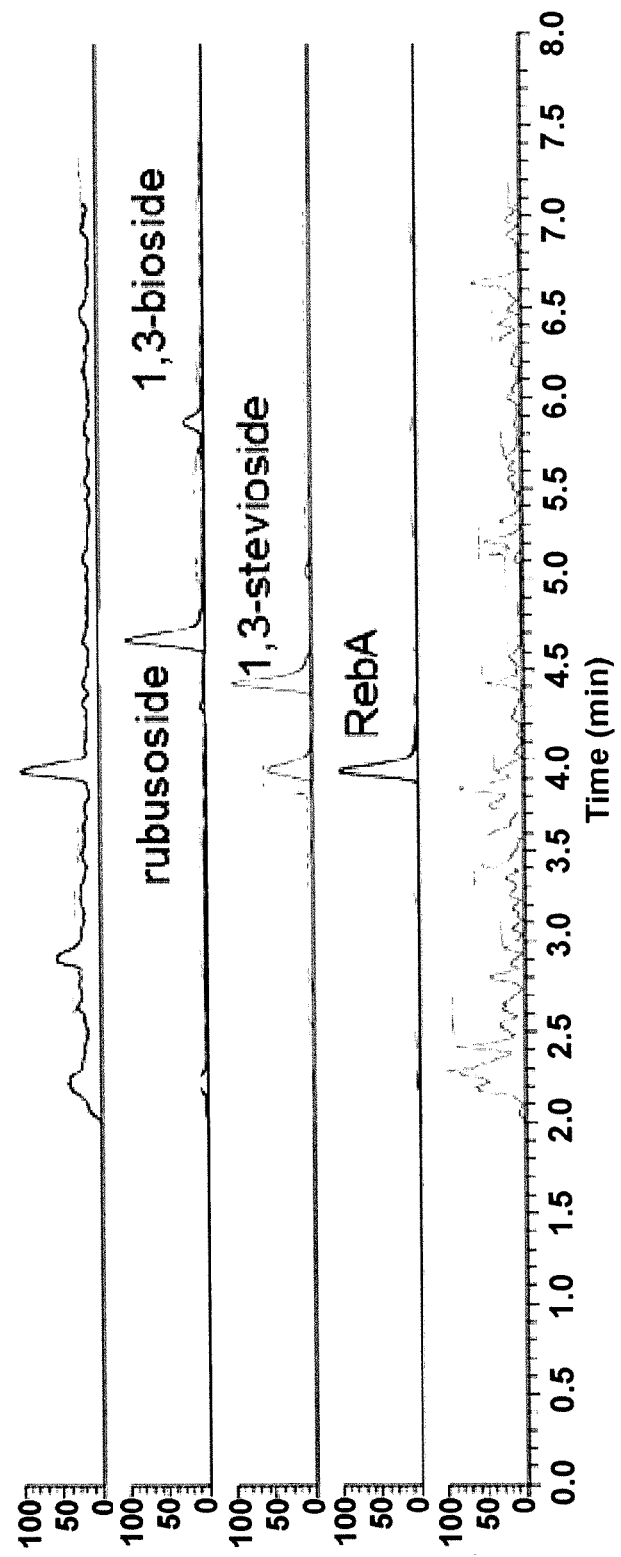
FIG. 11 is a chromatographic trace of steviol glycosides produced by the yeast 4X transporter disruption mutant strain expressing four S. rebaudiana UGTs (76G1, 74G1, 91D2e, and 85C2). Y-axis=relative amount according to automated scaling in the display. From top to bottom the rows are m/z traces that correspond to monoglucosides, biosides, steviol plus 3 glucose residues, steviol+4 glucose residues, and steviol+5 glucose residues.
Figure 12:
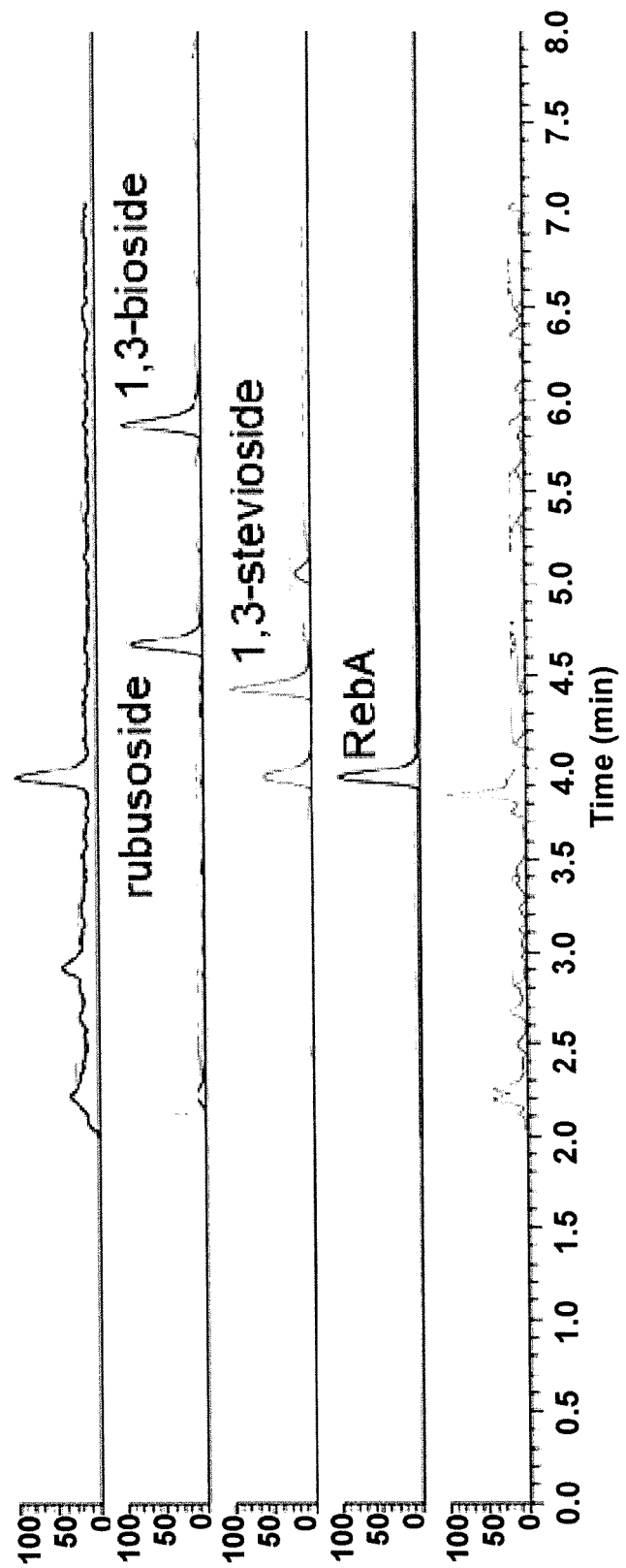
FIG. 12 is a chromatographic trace of steviol glycosides produced by the yeast 7X transporter disruption mutant strain expressing four S. rebaudiana UGTs (76G1, 74G1, 91D2e, and 85C2). Y-axis=relative amount according to automated scaling in the display. From top to bottom the rows are m/z traces that correspond to monoglucosides, biosides, steviol plus 3 glucose residues, steviol+4 glucose residues, and steviol+5 glucose residues.

The results are shown in FIGS. 10-12. As shown in FIG. 10, the wild-type strain excreted 19-SMG and 13-SMG into the extracellular broth. As shown in FIG. 11 and FIG. 12, the 4X- and 7X transporter disruption mutants did not secrete 19-SMG and 13-SMG into the extracellular broth. However, the 4X- and 7X transporter disruption mutants did excrete larger amounts of the 1,3-bioside than the wild-type strain (see FIG. 12). These data show that disrupting endogenous transporters has an effect on steviol glycoside accumulation in yeast.

The above data illustrate that knockouts of endogenous transporters in yeast singly or in combination and screening for increased retention of steviol glycosides, is a good method for identifying potential transporters for overexpression to improve steviol glycoside excretion in the medium.

Further Screening of Transporter Mutants

Figure 13:
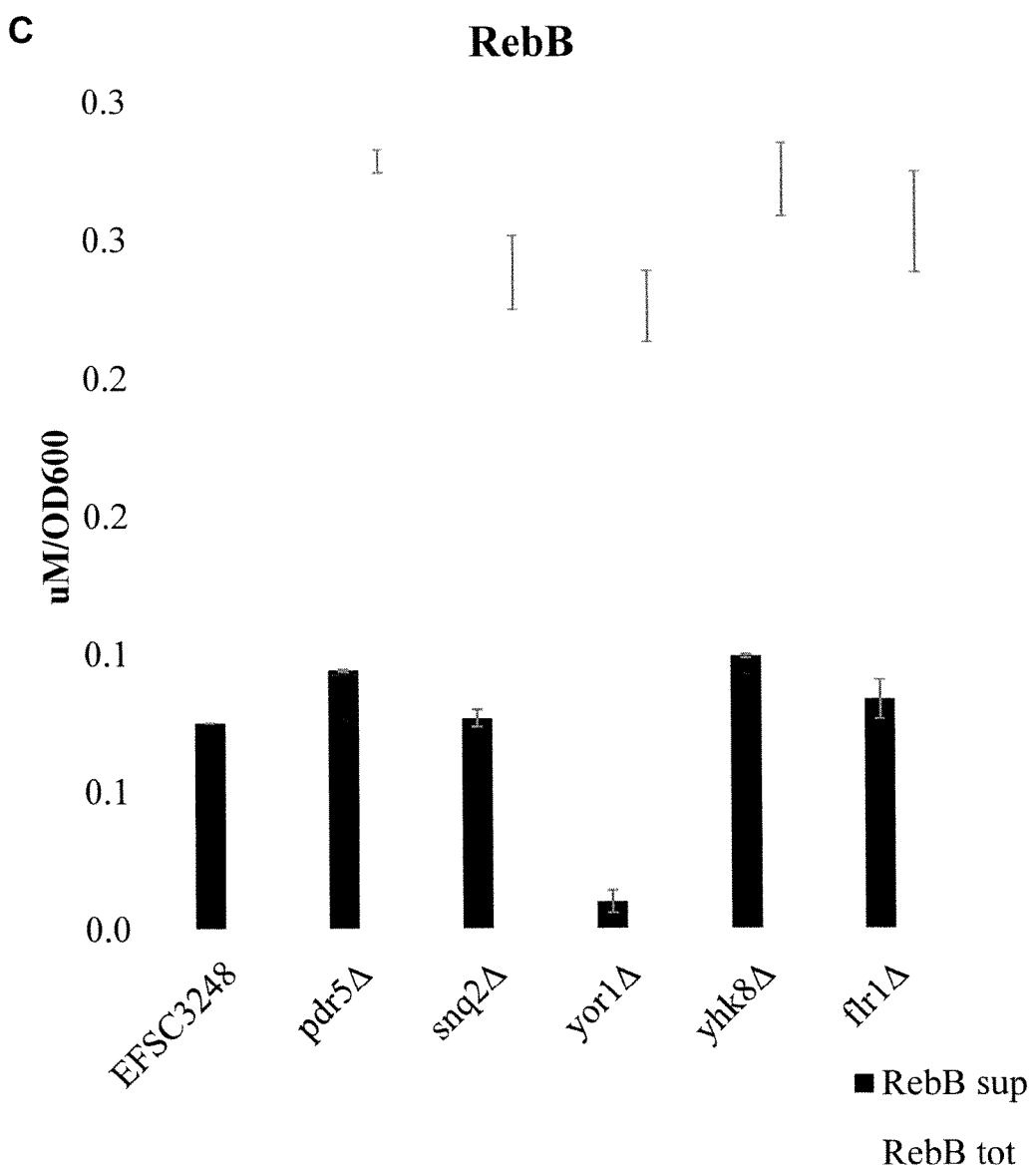
FIG. 13A-D is a bar graph of the concentration (FIG. 13A-B) or micromolar/OD600 (FIG. 13C) or percent (FIG. 13D-F) of each steviol glycocoside excreted in the supernatant of the yeast strains containing single deletion of specific transporters genes (PDR5, SNQ2, YOR1, YHK8, FLR1).
Figure 13:
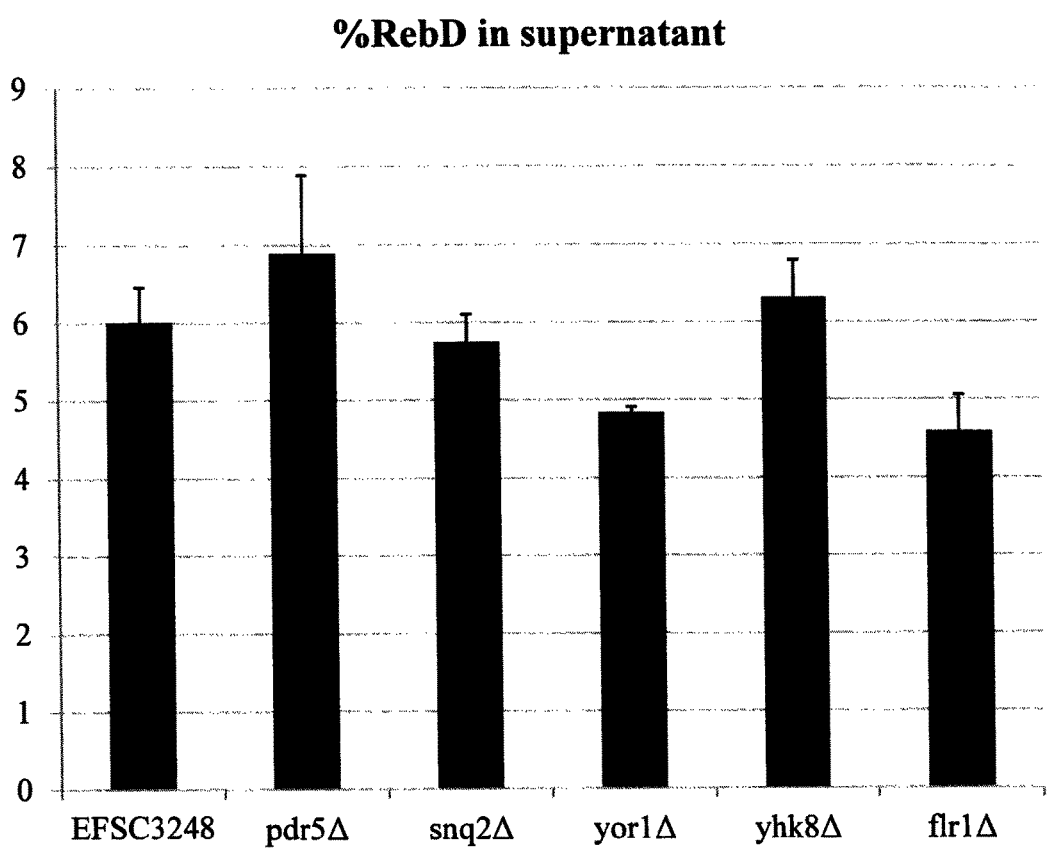

The effect of yeast gene knockouts on excretion of higher molecular weight rebaudiosides was tested in yeast strain EFSC3248, described in Example 2. Disruption of each specific transporter gene (PDR5, SNQ2, YOR1, YHK8 and FLR1) on the chromosome was performed by homologous recombination as described previously. After a 96 hour incubation (at 30° C. and 200 rpm), cells were harvested. A 100 µL aliquot of the culture was spun down and an equal volume of 100% DMSO was added to the supernatant. Eighty microliters of the mixture were analyzed by LC-MS as 'supernatant' sample. One-hundred microliters of cell suspension in 100 uL of 100% DMSO was heated at 80° C. for 10 minutes and then centrifuged. The mixture was vortexed, heated at 80° C. for 10 minutes, and centrifuged to remove any remaining debris. Forty microliters of the resulting solution was mixed with 40 uL DMSO (50%) and samples were analyzed by LC-MS as 'total' sample. The amount of various steviol glycosides (including RebA, RebB, RebD, RebM, Rubusoside, 13-SMG, 1.2 Stevioside, 1.2 Bioside and an unknown steviol glycoside (LC-MS peak at 4.13 min.)) excreted into the culture supernatant, as well as the total amount in the whole culture broth were measured by LC-MS as described in Example 1. The data demonstrate that disruption of single endogenous yeast transporter genes results in the decrease in the percentage (FIG. 13D-F) or amount excreted (FIG. 13 A-C) of various steviol glycosides in the supernatant of the culture media. Specifically, disruption of SNQ2, YOR1 and FLR1 led to a decrease of RebA, RebB and RebD excreted in the supernatant or yeast strain or decrease of RebA, RebB and RebD concentration in yeast strains compared to control (see FIG. 13 A-F; control in FIG. 13 is "EFSC3248").

Having described the invention in detail and by reference to specific embodiments thereof, it will be apparent that modifications and variations are possible without departing from the scope of the invention defined in the appended claims. More specifically, although some aspects of the present invention are identified herein as particularly advantageous, it is contemplated that the present invention is not necessarily limited to these particular aspects of the invention.

SEQUENCE LISTING (159 sequences)

SEQ ID NO: 1 - protein, 784 aa, Stevia rebaudiana
MNLSLCIASPLLTKSNRPAALSAIHTASTSHGGQTNPTNLIIDTTKERIQKQFKNVEISVSSYDTAWVAMVPSPNSPKSPCFPECLNWLINNQLNDGSWGLVNHTHNHNHPLLKDSLSSTLACIVALKRWNVGEDQINKGLSFIESNLASATEKSQPSPIGFDIIFPGLLEYAKNLDINLLSKQTDFSLMLHKRELEQKRCHSNEMDGYLAYISEGLGNLYDWNMVKKYQMKNGSVFNSPSATAAAFINHQNPGCLNYLNSLLDKFGNAVPTVYPHDLFIRLSMVDTIERLGISHHFRVEIKNVLDETYRCWVERDEQIFMDVVTCALAFRLLRINGYEVSPDPLAEITNELALKDEYAALETYHASHILYQEDLSSGKQILKSADFLKEIISTDSNRLSKLIHKEVENALKFPINTGLERINTRRNIQLYNVDNTRILKTTYHSSNISNTDYLRLAVEDFYTCQSIYREELKGLERWVVENKLDQLKFARQKTAYCYFSVAATLSSPELSDARISWAKNGILTTVVDDFFDIGGTIDELTNLIQCVEKWNVDVDKDCCSEHVRILFLALKDAICWIGDEAFKWQARDVTSHVIQTWLELMNSMLREAIWTRDAYVPTLNEYMENAYVSFALGPIVKPAIYFVGPKLSEEIVESSEYHNLFKLMSTQGRLLNDIHSFKREFKEGKLNAVALHLSNGESGKVEEEVVEEMMMMIKNKRKELMKLIFEENGSIVPRACKDAFWNMCHVLNFFYANDDGFTGNTILDTVKDIIYNPLVLVNENEEQR

SEQ ID NO: 2 - protein, 784 aa, Stevia rebaudiana
MNLSLCIASPLLTKSSRPTALSAIHTASTSHGGQTNPTNLIIDTTKERIQKLFKNVEISVSSYDTAWVAMVPSPNSPKSPCFPECLNWLINNQLNDGSWGLVNHTHNHNHPLLKDSLSSTLACIVALKRWNVGEDQINKGLSFIESNLASATDKSQPSPIGFDIIFPGLLEYAKNLDINLLSKQTDFSLMLHKRELEQKRCHSNEIDGYLAYISEGLGNLYDWNMVKKYQMKNGSVFNSPSATAAAFINHQNPGCLNYLNSLLDKFGNAVPTVYPLDLYIRLSMVDTIERLGISHHFRVEIKNVLDETYRCWVERDEQIFMDVVTCALAFRLLRIHGYKVSPDQLAEITNELAFKDEYAALETYHASQILYQEDLSSGKQILKSADFLKGILSTDSNRLSKLIHKEVENALKFPINTGLERINTRRNIQLYNVDNTRILKTTYHSSNISNTYYLRLAVEDFYTCQSIYREELKGLERWVVQNKLDQLKFARQKTAYCYFSVAATLSSPELSDARISWAKNGILTTVVDDFFDIGGTIDELTNLIQCVEKWNVDVDKDCCSEHVRILFLALKDAICWIGDEAFKWQARDVTSHVIQTWLELMNSMLREAIWTRDAYVPTLNEYMENAYVSFALGPIVKPAIYFVGPKLSEEIVESSEYHNLFKLMSTQGRLLNDIHSFKREFKEGKLNAVALHLSNGESGKVEEEVVEEMMMMIKNKRKELMKLIFEENGSIVPRACKDAFWNMCHVLNFFYANDDGFTGNTILDTVKDIIYNPLVLVNENEEQR

SEQ ID NO: 3 - protein, 590 aa, Zea mays
MAMPVKLTPASLSLKAVCCRFSSGGHALRFGSSLPCWRRTPTQRSTSSSTTRPAAEVSSGKSKQHDQEASEATIRQQLQLVDVLENMGISRHFAAEIKCILDRTYRSWLQRHEEIMLDTMTCAMAFRILRLNGYNVSSDELYHVVEASGLHNSLGGYLNDTRTLLELHKASTVSISEDESILDSIGSRSRTLLREQLESGGALRKPSLFKEVEHALDGPFYTTLDRLHHRWNIENFNIIEQHMLETPYLSNQHTSRDILALSIRDFSSSQFTYQQELQHLESWVKECRLDQLQFARQKLAYFYLSAAGTMFSPELSDARTLWAKNGVLTTIVDDFFDVAGSKEELENLVMLVEMWDEHHKVEFYSEQVEIIFSSIYDSVNQLGEKASLVQDRSITKHLVEIWLDLLKSMMTEVEWRLSKYVPTEKEYMINASLIFGLGPIVLPALYFVGPKISESIVKDPEYDELFKLMSTCGRLLNDVQTFEREYNEGKLNSVSLLVLHGGPMSISDAKRKLQKPIDTCRRDLLSLVLREESVVPRPCKELFWKMCKVCYFFYSTTDGFSSQVERAKEVDAVINEPLKLQGSHTLVSDV

SEQ ID NO: 4 - protein, 775 aa, Populus trichocarpa
MSCIRPWFCPSSISATLTDPASKLVTGEFKTTSLNFHGTKERIKKMFDKIELSVSSYDTAWVAMVPSPDCPETPCFPECTKWILENQLGDGSWSLPHGNPLLVKDALSSTLACILALKRWGIGEEQINKGLRFIELNSASVTDNEQHKPIGFDIIFPGMIEYAKDLDLNLPLKPTDINSMLHRRALELTSGGGKNLEGRRAYLAYVSEGIGKLQDWEMAMKYQRKNGSLFNSPSTTAAAFIHIQDAECLHYIRSLLQKFGNAVPTIYPLDIYARLSMVDALERLGIDRHFRKERKFVLDETYRFWLQGEEEIFSDNATCALAFRILRLNGYDVSLEDHFSNSLGGYLKDSGAALELYRALQLSYPDESLLEKQNSRTSYFLKQGLSNVSLCGDRLRKNIIGEVHDALNFPDHANLQRLAIRRRIKHYATDDTRILKTSYRCSTIGNQDFLKLAVEDFNICQSIQREEFKHIERWVVERRLDKLKFARQKEAYCYFSAAATLFAPELSDARMSWAKNGVLTTVVDDFFDVGGSEEELVNLIELIERWDVNGSADFCSEEVEIIYSAIHSTISEIGDKSFGWQGRDVKSHVIKIWLDLLKSMLTEAQWSSNKSVPTLDEYMTTAHVSFALGPIVLPALYFVGPKLSEEVAGHPELLNLYKVMSTCGRLLNDWRSFKRESEEGKLNAISLYMIHSGGASTEEETIEHFKGLIDSQRRQLLQLVLQEKDSIIPRPCKDLFWNMIKLLHTFYMKDDGFTSNEMRNVVKAIINEPISLDEL

SEQ ID NO: 5 - DNA, 2506 bp, Arabidopsis thaliana
cgtcagtcatcaaggctaattcgtcgcgagttgctacgacgccgtttcggttgcttctggtttctttatgtctatcaaccttcgctcctccggttgttcgtctccgatctcagctactttggaacgaggattggactcagaagtacagacaagagctaacaatgtgagctttgagcaaacaaaggagaagattaggaagatgttggagaaagtggagctttctgtttcggcctacgatactagttgggtagcaatggttccatcaccgagctcccaaaatgctccacttttcccacagtgtgtgaaatggttattggataatcaacatgaagatggatcttggggacttgataaccatgaccatcaatctcttaagaaggatgtgttatcatctacactggctagtatcctcgcgttaaagaagtggggaattggtgaaagacaaataaacaagggtctccagtttattgagctgaattctgcattagtcactgatgaaaccatacagaaaccaacagggtttgatattatatttcctgggatgattaaatatgctagagatttgaatctgacgattccattgggctcagaagtggtggatgacatgatacgaaaaagagatctggatcttaaatgtgatagtgaaaagttttcaaagggaagagaagcatatctggcctatgttttagaggggacaagaaacctaaaagattgggatttgatagtcaaatatcaaaggaaaaatgggtcactgtttgattctccagccacaacagcagctgcttttactcagtttgggaatgatggttgtctccgttatctctgttctctccttcagaaattcgaggctgcagttccttcagtttatccatttgatcaatatgcacgccttagtataattgtcactcttgaaagcttaggaattgatagagatttcaaaaccgaaatcaaaagcatattggatgaaacctatagatattggcttcgtggggatgaagaaatatgtttggacttggccacttgtgctttggctttccgattattgcttgctcatggctatgatgtgtcttacgatccgctaaaaccatttgcagaagaatctggtttctctgatactttggaaggatatgttaagaatacgttttctgtgttagaattatttaaggctgctcaaagttatccacatgaatcagctttgaagaagcagtgttgttggactaaacaatatctggagatggaattgtccagctgggttaagacctctgttcgagataaatacctcaagaaagaggtcgaggatgctcttgcttttccctcctatgcaagcctagaaagatcagatcacaggagaaaaatactcaatggttctgctgtggaaaacaccagagttacaaaaacctcatatcgtttgcacaatatttgcacctctgatatcctgaagttagctgtggatgacttcaatttctgccagtccatacaccgtgaagaaatggaacgtcttgataggtggattgtggagaatagattgcaggaactgaaatttgccagacagaagctggcttactgttatttctctggggctgcaactttattttctccagaactatctgatgctcgtatatcgtgggccaaaggtggagtacttacaacggttgtagacgacttctttgatgttggagggtccaaagaagaactggaaaacctcatacacttggtcgaaaagtgggatttgaacggtgttcctgagtacagctcagaacatgttgagatcatattctcagttctaagggacaccattctcgaaacaggagacaaagcattcacctatcaaggacgcaatgtgacacaccacattgtgaaaatttggttggatctgctcaagtctatgttgagagaagccgagtggtccagtgacaagtcaacaccaagcttggaggattacatggaaaatgcgtacatatcatttgcattaggaccaattgtcctcccagctacctatctgatcggacctccacttccagagaagacagtcgatagccaccaatataatcagctctacaagctcgtgagcactatgggtcgtcttctaaatgacatacaaggttttaagagagaaagcgcggaagggaagctgaatgcggtttcattgcacatgaaacacgagagagacaatcgcagcaaagaagtgatcatagaatcgatgaaaggtttagcagagagaaagagggaagaattgcataagctagttttggaggagaaaggaagtgtggttccaagggaatgcaaagaagcgttcttgaaaatgagcaaagtgttgaacttattttacaggaaggacgatggattcacatcaaatgatctgatgagtcttgttaaatcagtgatctacgagcctgttagcttacagaaagaatctttaacttgatccaagttgatctggcaggtaaactcagtaaatgaaaataagactttggtcttcttctttgttgcttcagaacaagaagag

SEQ ID NO: 6 - protein, 785 aa, Arabidopsis thaliana
MSINLRSSGCSSPISATLERGLDSEVQTRANNVSFEQTKEKIRKMLEKVELSVSAYDTSWVAMVPSPSSQNAPLFPQCVKWLLDNQHEDGSWGLDNHDHQSLKKDVLSSTLASILALKKWGIGERQINKGLQFIELNSALVTDETIQKPTGFDIIFPGMIKYARDLNLTIPLGSEVVDDMIRKRDLDLKCDSEKFSKGREAYLAYVLEGTRNLKDWDLIVKYQRKNGSLFDSPATTAAAFTQFGNDGCLRYLCSLLQKFEAAVPSVYPFDQYARLSIIVTLESLGIDRDFKTEIKSILDETYRYWLRGDEEICLDLATCALAFRLLLAHGYDVSYDPLKPFAEESGFSDTLEGYVKNTFSVLELFKAAQSYPHESALKKQCCWTKQYLEMELSSWVKTSVRDKYLKKEVEDALAFPSYASLERSDHRRKILNGSAVENTRVTKTSYRLHNICTSDILKLAVDDFNFCQSIHREEMERLDRWIVENRLQELKFARQKLAYCYFSGAATLFSPELSDARISWAKGGVLTTVVDDFFDVGGSKEELENLIHLVEKWDLNGVPEYSSEHVEIIFSVLRDTILETGDKAFTYQGRNVTHHIVKIWLDLLKSMLREAEWSSDKSTPSLEDYMENAYISFALGPIVLPATYLIGPPLPEKTVDSHQYNQLYKLVSTMGRLLNDIQGFKRESAEGKLNAVSLHMKHERDNRSKEVIIESMKGLAERKREELHKLVLEEKGSVVPRECKEAFLKMSKVLNLFYRKDDGFTSNDLMSLVKSVIYEPVSLQKESLT

SEQ ID NO: 7 - protein, 513 aa, Arabidopsis thaliana
MDAVTGLLTVPATAITIGGTAVALAVALIFWYLKSYTSARRSQSNHLPRVPEVPGVPLLGNLLQLKEKKPYMTFTRWAATYGPIYSIKTGATSMVVVSSNEIAKEALVTRFQSISTRNLSKALKVLTADKTMVAMSDYDDYHKTVKRHILTAVLGPNAQKKHRIHRDIMMDNISTQLHEFVKNNPEQEEVDLRKIFQSELFGLAMRQALGKDVESLYVEDLKITMNRDEIFQVLVVDPMMGAIDVDWRDFFPYLKWVPNKKFENTIQQMYIRREAVMKSLIKEHKKRIASGEKLNSYIDYLLSEAQTLTDQQLLMSLWEPIIESSDTTMVTTEWAMYELAKNPKLQDRLYRDIKSVCGSEKITEEHLSQLPYITAIFHETLRRHSPVPIIPLRHVHEDTVLGGYHVPAGTELAVNIYGCNMDKNVWENPEEWNPERFMKENETIDFQKTMAFGGGKRVCAGSLQALLTASIGIGRMVQEFEWKLKDMTQEEVNTIGLTTQMLRPLRAIIKPRI

SEQ ID NO: 8 - protein, 509 aa, Arabidopsis thaliana
MAFFSMISILLGFVISSFIFIFFFKKLLSFSRKNMSEVSTLPSVPVVPGFPVIGNLLQLKEKKPHKTFTRWSEIYGPIYSIKMGSSSLIVLNSTETAKEAMVTRFSSISTRKLSNALTVLTCDKSMVATSDYDDFHKLVKRCLLNGLLGANAQKRKRHYRDALIENVSSKLHAHARDHPQEPVNFRAIFEHELFGVALKQAFGKDVESIYVKELGVTLSKDEIFKVLVHDMMEGAIDVDWRDFFPYLKWIPNKSFEARIQQKHKRRLAVMNALIQDRLKQNGSESDDDCYLNFLMSEAKTLTKEQIAILVWETIIETADTTLVTTEWAIYELAKHPSVQDRLCKEIQNVCGGEKFKEEQLSQVPYLNGVFHETLRKYSPAPLVPIRYAHEDTQIGGYHVPAGSEIAINIYGCNMDKKRWERPEDWWPERFLDDGKYETSDLHKTMAFGAGKRVCAGALQASLMAGIAIGRLVQEFEWKLRDGEEENVDTYGLTSQKLYPLMAIINPRRS

SEQ ID NO: 9 - protein, 525 aa, Fusarium fujikuroi
MSKSNSMNSTSHETLFQQLVLGLDRMPLMDVHWLIYVAFGAWLCSYVIHVLSSSSTVKVPVVGYRSVFEPTWLLRLRFVWEGGSIIGQGYNKFKDSIFQVRKLGTDIVIIPPNYIDEVRKLSQDKTRSVEPFINDFAGQYTRGMVFLQSDLQNRVIQQRLTPKLVSLTKVMKEELDYALTKEMPDMKNDEWVEVDISSIMVRLISRISARVFLGPEHCRNQEWLTTTAEYSESLFITGFILRVVPHILRPFIAPLLPSYRTLLRNVSSGRRVIGDIIRSQQGDGNEDILSWMRDAATGEEKQIDNIAQRMLILSLASIHTTAMTMTHAMYDLCACPEYIEPLRDEVKSVVGASGWDKTALNRFHKLDSFLKESQRFNPVFLLTFNRIYHQSMTLSDGTNIPSGTRIAVPSHAMLQDSAHVPGPTPPTEFDGFRYSKIRSDSNYAQKYLFSMTDSSNMAFGYGKYACPGRFYASNEMKLTLAILLLQFEFKLPDGKGRPRNITIDSDMIPDPRARLCVRKRSLRDE

SEQ ID NO: 10 - protein, 499 aa, Trametes versicolor
MEDPTVLYACLAIAVATFVVRWYRDPLRSIPTVGGSDLPILSYIGALRWTRRGREILQEGYDGYRGSTFKIAMLDRWIVIANGPKLADEVRRRPDEELNFMDGLGAFVQTKYTLGEAIHNDPYHVDIIREKLTRGLPAVLPDVIEELTLAVRQYIPTEGDEWVSVNCSKAARDIVARASNRVFVGLPACRNQGYLDLAIDFTLSVVKDRAIINMFPELLKPIVGRVVGNATRNVRRAVPFVAPLVEERRRLMEEYGEDWSEKPNDMLQWIMDEAASRDSSVKAIAERLLMVNFAAIHTSSNTITHALYHLAEMPETLQPLREEIEPLVKEEGWTKAAMGKMWWLDSFLRESQRYNGINIVSLTRMADKDITLSDGTFLPKGTLVAVPAYSTHRDDAVYADALVFDPFRFSRMRAREGEGTKHQFVNTSVEYVPFGHGKHACPGRFFAANELKAMLAYIVLNYDVKLPGDGKRPLNMYWGPTVLPAPAGQVLFRKRQVSL

SEQ ID NO: 11 - DNA, 1678 bp, Stevia rebaudiana
aaacaaagaatgattcaagttctaacaccgatccttctcttcctcattttcttcgttttctggaaggtttacaagcaccagaaaaccaaaatcaatcttccaccgggaagcttcggatggccatttctgggcgaaactctggcactcctacgtgcaggttgggactcagagccggagagatttgttcgtgaacggatcaagaaacacggaagtcctctagtgtttaagacgtcgttgtttggcgaccgttttgcggtgttgtgtggacctgccggaaacaagttcctgttctgcaacgagaacaagctggtggcgtcgtggtggccggttccggtgaggaagcttttcggcaagtctctgctcacgattcgtggtgatgaagctaagtggatgaggaagatgttgttatcgtatctcggtcctgatgctttcgcaactcattatgccgtcaccatggacgtcgtcacccgtcggcatatcgacgttcattggcgagggaaggaagaggtgaacgtattccaaaccgttaagttatatgcctttgagcttgcatgtcgtttattcatgaacctagacgacccaaaccacattgcaaaactcggttccttgttcaacattttcttgaaaggcatcattgagcttccaatcgacgtcccagggacacgattttatagctccaaaaaagcagcagcagctatcaggattgaactaaaaaaattgattaaagcaagaaaactggaactgaaagaagggaaggcatcatcttcacaagacctcttatcacatttgcttacatctccagatgaaaatggtatgtttctaaccgaagaagagattgtagacaacatcttgttactactctttgcgggtcatgatacctcggctctttcaatcactttgctcatgaagactcttggcgaacattctgatgtttatgacaaggtgttaaaagagcaactagagatatcgaagacgaaagaagcatgggagtccctgaaatgggaggacatacaaaagatgaaatactcctggagtgttatatgtgaagtcatgagactaaatccacctgttataggaacctatagagaggcccttgtggatattgattatgcgggttataccatccccaaaggatggaagctgcactggagtgctgtatcgacacaaagggacgaggctaactttgaagacgtaacacgttttgacccatcacggtttgaaggcgcaggaccgactccattcacctttgttccgtttggaggggggcctagaatgtgtttagggaaagaatttgctcgattggaagtacttgcgtttcttcacaatattgtcaccaatttcaaatgggacctgttgatacctgatgagaaaatagaatatgatcccatggctaccccagcaaaggggcttccaattcgtcttcatccccatcaagtttgattacttcaagcatgaatcagtgatgtgaaggtaaaccataatggatcttattggtagttacagattatgtgtttttatggcatgaagaagttatgataaataaaattgtgttattctacaacttatgtaatttgtgcctgtaagtaactgaatctattaatgttttatgtgacatgaaacataaatgtataattagtaaattttctgctcaaaaaaaaaaaaaaaaaaaaaaaaaaaa

SEQ ID NO: 12 - protein, 476 aa, Stevia rebaudiana
MIQVLTPILLFLIFFVFWKVYKHQKTKINLPPGSFGWPFLGETLALLRAGWDSEPERFVRERIKKHGSPLVFKTSLFGDRFAVLCGPAGNKFLFCNENKLVASWWPVPVRKLFGKSLLTIRGDEAKWMRKMLLSYLGPDAFATHYAVTMDVVTRRHIDVHWRGKEEVNVFQTVKLYAFELACRLFMNLDDPNHIAKLGSLFNIFLKGIIELPIDVPGTRFYSSKKAAAAIRIELKKLIKARKLELKEGKASSSQDLLSHLLTSPDENGMFLTEEEIVDNILLLLFAGHDTSALSITLLMKTLGEHSDVYDKVLKEQLEISKTKEAWESLKWEDIQKMKYSWSVICEVMRLNPPVIGTYREALVDIDYAGYTIPKGWKLHWSAVSTQRDEANFEDVTRFDPSRFEGAGPTPFTFVPFGGGPRMCLGKEFARLEVLAFLHNIVTNFKWDLLIPDEKIEYDPMATPAKGLPIRLHPHQV

SEQ ID NO: 13 - protein, 522 aa, Stevia rebaudiana
MGLFPLEDSYALVFEGLAITLALYYLLSFIYKTSKKTCTPPKASGEHPITGHLNLLSGSSGLPHLALASLADRCGPIFTIRLGIRRVLVVSNWEIAKEIFTTHDLIVSNRPKYLAAKILGFNYVSFSFAPYGPYWVGIRKIIATKLMSSSRLQKLQFVRVFELENSMKSIRESWKEKKDEEGKVLVEMKKWFWELNMNIVLRTVAGKQYTGTVDDADAKRISELFREWFHYTGRFVVGDAFPFLGWLDLGGYKKTMELVASRLDSMVSKWLDEHRKKQANDDKKEDMDFMDIMISMTEANSPLEGYGTDTIIKTTCMTLIVSGVDTTSIVLTWALSLLLNNRDTLKKAQEELDMCVGKGRQVNESDLVNLIYLEAVLKEALRLYPAAFLGGPRAFLEDCTVAGYRIPKGTCLLINMWKLHRDPNIWSDPCEFKPERFLTPNQKDVDVIGMDFELIPFGAGRRYCPGTRLALQMLHIVLATLLQNFEMSTPNDAPVDMTASVGMTNAKASPLEVLLSPRVKWS

SEQ ID NO: 14 - protein, 476 aa, Stevia rebaudiana; identical to SEQ ID NO: 12

SEQ ID NO: 15 - protein, 525 aa, Arabidopsis thaliana
MESLVVHTVNAIWCIVIVGIFSVGYHVYGRAVVEQWRMRRSLKLQGVKGPPPSIFNGNVSEMQRIQSEAKHCSGDNIISHDYSSSLFPHFDHWRKQYGRIYTYSTGLKQHLYINHPEMVKELSQTNTLNLGRITHITKRLNPILGNGIITSNGPHWAHQRRIIAYEFTHDKIKGMVGLMVESAMPMLNKWEEMVKRGGEMGCDIRVDEDLKDVSADVIAKACFGSSFSKGKAIFSMIRDLLTAITKRSVLFRFNGFTDMVFGSKKHGDVDIDALEMELESSIWETVKEREIECKDTHKKDLMQLILEGAMRSCDGNLWDKSAYRRFVVDNCKSIYFAGHDSTAVSVSWCLMLLALNPSWQVKIRDEILSSCKNGIPDAESIPNLKTVTMVIQETMRLYPPAPIVGREASKDIRLGDLVVPKGVCIWTLIPALHRDPEIWGPDANDFKPERFSEGISKACKYPQSYIPFGLGPRTCVGKNFGMMEVKVLVSLIVSKFSFTLSPTYQHSPSHKLLVEPQHGVVIRVV

SEQ ID NO: 16 - protein, 526 aa, Vitis vinifera
MYFLLQYLNITTVGVFATLFLSYCLLLWRSRAGNKKIAPEAAAAWPIIGHLHLLAGGSHQLPHITLGNMADKYGPVFTIRIGLHRAVVVSSWEMAKECSTANDQVSSSRPELLASKLLGYNYAMFGFSPYGSYWREMRKIISLELLSNSRLELLKDVRASEVVTSIKELYKLWAEKKNESGLVSVEMKQWFGDLTLNVILRMVAGKRYFSASDASENKQAQRCRRVFREFFHLSGLFVVADAIPFLGWLDWGRHEKTLKKTAIEMDSIAQEWLEEHRRRKDSGDDNSTQDFMDVMQSVLDGKNLGGYDADTINKATCLTLISGGSDTTVVSLTWALSLVLNNRDTLKKAQEELDIQVGKERLVNEQDISKLVYLQAIVKETLRLYPPGPLGGLRQFTEDCTLGGYHVSKGTRLIMNLSKIQKDPRIWSDPTEFQPERFLTTHKDVDPRGKHFEFIPFGAGRRACPGITFGLQVLHLTLASFLHAFEFSTPSNEQVNMRESLGLTNMKSTPLEVLISPRLSSCSLYN

SEQ ID NO: 17 - protein, 479 aa, Medicago truncatula
MEPNFYLSLLLLFVTFISLSLFFIFYKQKSPLNLPPGKMGYPIIGESLEFLSTGWKGHPEKFIFDRMRKYSSELFKTSIVGESTVVCCGAASNKFLFSNENKLVTAWWPDSVNKIFPTTSLDSNLKEESIKMRKLLPQFFKPEALQRYVGVMDVIAQRHFVTHWDNKNEITVYPLAKRYTFLLACRLFMSVEDENHVAKFSDPFQLIAAGIISLPIDLPGTPFNKAIKASNFIRKELIKIIKQRRVDLAEGTASPTQDILSHMLLTSDENGKSMNELNIADKILGLLIGGHDTASVACTFLVKYLGELPHIYDKVYQEQMEIAKSKPAGELLNWDDLKKMKYSWNVACEVMRLSPPLQGGFREAITDFMFNGFSIPKGWKLYWSANSTHKNAECFPMPEKFDPTRFEGNGPAPYTFVPFGGGPRMCPGKEYARLEILVFMHNLVKRFKWEKVIPDEKIIVDPFPIPAKDLPIRLYPHKA

SEQ ID NO: 18 - DNA, 1503 bp, Artificial Sequence
  Codon-optimized Stevia rebaudiana KAHe1
atggaagcctcttacctatacatttctattttgcttttactggcatcatacctgttcaccactcaacttagaaggaagagcgctaatctaccaccaaccgtgtttccatcaataccaatcattggacacttatacttactcaaaaagcctctttatagaactttagcaaaaattgccgctaagtacggaccaatactgcaattacaactcggctacagacgtgttctggtgatttcctcaccatcagcagcagaagagtgctttaccaataacgatgtaatcttcgcaaatagacctaagacattgtttggcaaaatagtgggtggaacatcccttggcagtttatcctacggcgatcaatggcgtaatctaaggagagtagcttctatcgaaatcctatcagttcataggttgaacgaatttcatgatatcagagtggatgagaacagattgttaattagaaaacttagaagttcatcttctcctgttactcttataacagtcttttatgctctaacattgaacgtcattatgagaatgatctctggcaaaagatatttcgacagtggggatagagaattggaggaggaaggtaagagatttcgagaaatcttagacgaaacgttgcttctagccggtgcttctaatgttggcgactacttaccaatattgaactggttgggagttaagtctcttgaaaagaaattgatcgctttgcagaaaaagagagatgactttttccagggtttgattgaacaggttagaaaatctcgtggtgctaaagtaggcaaaggtagaaaaacgatgatcgaactcttattatctttgcaagagtcagaacctgagtactatacagatgctatgataagatcttttgtcctaggtctgctggctgcaggtagtgatacttcagcgggcactatggaatgggccatgagcttactggtcaatcacccacatgtattgaagaaagctcaagctgaaatcgatagagttatcggtaataacagattgattgacgagtcagacattggaaatatcccttacatcgggtgtattatcaatgaaactctaagactctatccagcagggccattgttgttcccacatgaaagttctgccgactgcgttatttccggttacaatatacctagaggtacaatgttaatcgtaaaccaatgggcgattcatcacgatcctaaagtctgggatgatcctgaaacctttaaacctgaaagatttcaaggattagaaggaactagagatggtttcaaacttatgccattcggttctgggagaagaggatgtccaggtgaaggtttggcaataaggctgttagggatgacactaggctcagtgatccaatgttttgattgggagagagtaggagatgagatggttgacatgacagaaggtttgggtgtcacacttcctaaggccgttccattagttgccaaatgtaagccacgttccgaaatgactaatctcctatccgaactttaa

SEQ ID NO: 19 - protein, 500 aa, Stevia rebaudiana
MEASYLYISILLLLASYLFTTQLRRKSANLPPTVFPSIPIIGHLYLLKKPLYRTLAKIAAKYGPILQLQLGYRRVLVISSPSAAEECFTNNDVIFANRPKTLFGKIVGGTSLGSLSYGDQWRNLRRVASIEILSVHRLNEFHDIRVDENRLLIRKLRSSSSPVTLITVFYALTLNVIMRMISGKRYFDSGDRELEEEGKRFREILDETLLLAGASNVGDYLPILNWLGVKSLEKKLIALQKKRDDFFQGLIEQVRKSRGAKVGKGRKTMIELLLSLQESEPEYYTDAMIRSFVLGLLAAGSDTSAGTMEWAMSLLVNHPHVLKKAQAEIDRVIGNNRLIDESDIGNIPYIGCIINETLRLYPAGPLLFPHESSADCVISGYNIPRGTMLIVNQWAIHHDPKVWDDPETFKPERFQGLEGTRDGFKLMPFGSGRRGCPGEGLAIRLLGMTLGSVIQCFDWERVGDEMVDMTEGLGVTLPKAVPLVAKCKPRSEMTNLLSEL

SEQ ID NO: 20 - protein, 710 aa, Stevia rebaudiana
MQSDSVKVSPFDLVSAAMNGKAMEKLNASESEDPTTLPALKMLVENRELLTLFTTSFAVLIGCLVFLMWRRSSSKKLVQDPVPQVIVVKKKEKESEVDDGKKKVSIFYGTQTGTAEGFAKALVEEAKVRYEKTSFKVIDLDDYAADDDEYEEKLKKESLAFFFLATYGDGEPTDNAANFYKWFTEGDDKGEWLKKLQYGVFGLGNRQYEHFNKIAIVVDDKLTEMGAKRLVPVGLGDDDQCIEDDFTAWKELVWPELDQLLRDEDDTSVTTPYTAAVLEYRVVYHDKPADSYAEDQTHTNGHVVHDAQHPSRSNVAFKKELHTSQSDRSCTHLEFDISHTGLSYETGDHVGVYSENLSEVVDEALKLLGLSPDTYFSVHADKEDGTPIGGASLPPPFPPCTLRDALTRYADVLSSPKKVALLALAAHASDPSEADRLKFLASPAGKDEYAQWIVANQRSLLEVMQSFPSAKPPLGVFFAAVAPRLQPRYYSISSSPKMSPNRIHVTCALVYETTPAGRIHRGLCSTWMKNAVPLTESPDCSQASIFVRTSNFRLPVDPKVPVIMIGPGTGLAPFRGFLQERLALKESGTELGSSIFFFGCRNRKVDFIYEDELNNFVETGALSELIVAFSREGTAKEYVQHKMSQKASDIWKLLSEGAYLYVCGDAKGMAKDVHRTLHTIVQEQGSLDSSKAELYVKNLQMSGRYLRDVW

SEQ ID NO: 21 - protein, 692 aa, Arabidopsis thaliana [sequence omitted]

SEQ ID NO: 22 - protein, 713 aa, Fusarium fujikuroi
MAELDTLDIVVLGVIFLGTVAYFTKGKLWGVTKDPYANGFAAGGASKPGRTRNIVEAMEESGKNCVVFYGSQTGTAEDYASRLAKEGKSRFGLNTMIADLEDYDFDNLDTVPSDNIVMFVLATYGEGEPTDNAVDFYEFITGEDASFNEGNDPPLGNLNYVAFGLGNNTYEHYNSMVRNVNKALEKLGAHRIGEAGEGDDGAGTMEEDFLAWKDPMWEALAKKMGLEEREAVYEPIFAINERDDLTPEANEVYLGEPNKLHLEGTAKGPFNSHNPYIAPIAESYELFSAKDRNCLHMEIDISGSNLKYETGDHIAIWPTNPGEEVNKFLDILDLSGKQHSVVTVKALEPTAKVPFPNPTTYDAILRYHLEICAPVSRQFVSTLAAFAPNDDIKAEMNRLGSDKDYFHEKTGPHYYNIARFLASVSKGEKWTKIPFSAFIEGLTKLQPRYYSISSSSLVQPKKISITAVVESQQIPGRDDPFRGVATNYLFALKQKQNGDPNPAPFGQSYELTGPRNKYDGIHVPVHVRHSNFKLPSDPGKPIIMIGPGTGVAPFRGFVQERAKQARDGVEVGKTLLFFGCRKSTEDFMYQKEWQEYKEALGDKFEMITAFSREGSKKVYVQHRLKERSKEVSDLLSQKAYFYVCGDAAHMAREVNTVLAQIIAEGRGVSEAKGEEIVKNMRSANQYQVCSDFVTLHCKETTYANSELQEDVWS

SEQ ID NO: 23 - DNA, 2130 bp, Stevia rebaudiana
atgcaatcggaatccgttgaagcatcgacgattgatttgatgactgctgttttgaaggacacagtgatcgatacagcgaacgcatctgataacggagactcaaagatgccgccggcgttggcgatgatgttcgaaattcgtgatctgttgctgattttgactacgtcagttgctgttttggtcggatgtttcgttgttttggtgtggaagagatcgtccgggaagaagtccggcaaggaattggagccgccgaagatcgttgtgccgaagaggcggctggagcaggaggttgatgatggtaagaagaaggttacgattttcttcggaacacaaactggaacggctgaaggtttcgctaaggcacttttcgaagaagcgaaagcgcgatatgaaaaggcagcgtttaaagtgattgatttggatgattatgctgctgatttggatgagtatgcagagaagctgaagaaggaaacatatgctttcttcttcttggctacatatggagatggtgagccaactgataatgctgccaaattttataaatggtttactgagggagacgagaaaggcgtttggcttcaaaaacttcaatatggagtatttggtcttggcaacagacaatatgaacatttcaacaagattggaatagtggttgatgatggtctcaccgagcagggtgcaaaacgcattgttcccgttggtcttggagacgacgatcaatcaattgaagacgatttttcggcatggaaagagttagtgtggcccgaattggatctattgcttcgcgatgaagatgacaaagctgctgcaactccttacacagctgcaatccctgaataccgcgtcgtatttcatgacaaacccgatgcgttttctgatgatcatactcaaaccaatggtcatgctgttcatgatgctcaacatccatgcagatccaatgtggctgttaaaaaagagcttcatactcctgaatccgatcgttcatgcacacatcttgaatttgacatttctcacactggattatcttatgaaactggggatcatgttggtgtatactgtgaaaacctaattgaagtagtggaagaagctgggaaattgttaggattatcaacagatacttatttctcgttacatattgataacgaagatggttcaccacttggtggaccttcattacaacctccttttcctccttgtactttaagaaaagcattgactaattatgcagatctgttaagctctcccaaaaagtcaactttgcttgctctagctgctcatgcttccgatcccactgaagctgatcgtttaagatttcttgcatctcgcgagggcaaggatgaatatgctgaatgggttgttgcaaaccaaagaagtcttcttgaagtcatggaagctttcccgtcagctagaccgccacttggtgttttctttgcagcggttgcaccgcgtttacagcctcgttactactctatttcttcctccccaaagatggaaccaaacaggattcatgttacttgcgcgttggtttatgaaaaaactcccgcaggtcgtatccacaaaggaatctgctcaacctggatgaagaacgctgtacctttgaccgaaagtcaagattgcagttgggcaccgatttttgttagaacatcaaacttcagacttccaattgacccgaaagtcccggttatcatgattggtcctggaaccgggttggctccatttaggggttttcttcaagaaagattggctcttaaagaatccggaaccgaactcgggtcatctattttattcttcggttgtagaaaccgcaaagtggattacatatatgagaatgaactcaacaactttgttgaaaatggtgcgctttctgagcttgatgttgctttctcccgcgatggcccgacgaaagaatacgtgcaacataaaatgacccaaaaggcttctgaaatatggaatatgctttctgagggagcatatttatatgtatgtggtgatgctaaaggcatggctaaagatgtacaccgtacacttcacaccattgtgcaagaacagggaagtttggactcgtctaaagcggagttgtatgtgaagaatctacaaatgtcaggaagatacctccgtgatgtttggtaa

SEQ ID NO: 24 - DNA, 2124 bp, Stevia rebaudiana
atgcaatctaactccgtgaagatttcgccgcttgatctggtaactgcgctgtttagcggcaaggttttggacacatcgaacgcatcggaatcgggagaatctgctatgctgccgactatagcgatgattatggagaatcgtgagctgttgatgatactcacaacgtcggttgctgtattgatcggatgcgttgtcgttttggtgtggcggagatcgtctacgaagaagtcggcgttggagccaccggtgattgtggttccgaagagagtgcaagaggaggaagttgatgatggtaagaagaaagttacggttttcttcggcacccaaactggaacagctgaaggcttcgctaaggcacttgttgaggaagctaaagctcgatatgaaaaggctgtctttaaagtaattgatttggatgattatgctgctgatgacgatgagtatgaggagaaactaaagaaagaatctttggcctttttctttttggctacgtatggagatggtgagccaacagataatgctgccagattttataaatggtttactgagggagatgcgaaaggagaatggcttaataagcttcaatatggagtatttggtttgggtaacagacaatatgaacattttaacaagatcgcaaaagtggttgatgatggtcttgtagaacagggtgcaaagcgtcttgttcctgttggacttggagatgatgatcaatgtattgaagatgacttcaccgcatggaaagagttagtatggccggagttggatcaattacttcgtgatgaggatgacacaactgttgctactccatacacagctgctgttgcagaatatcgcgttgtttttcatgaaaaaccagacgcgctttctgaagattatagttatacaaatggccatgctgttcatgatgctcaacatccatgcagatccaacgtggctgtcaaaaaggaacttcatagtcctgaatctgaccggtcttgcactcatcttgaatttgacatctcgaacaccggactatcatatgaaactggggaccatgttggagtttactgtgaaaacttgagtgaagttgtgaatgatgctgaaagattagtaggattaccaccagacacttactcctccatccacactgatagtgaagacgggtcgccacttggcggagcctcattgccgcctcctttcccgccatgcactttaaggaaagcattgacgtgttatgctgatgttttgagttctcccaagaagtcggctttgcttgcactagctgctcatgccaccgatcccagtgaagctgatagattgaaatttcttgcatcccccgccggaaaggatgaatattctcaatggatagttgcaagccaaagaagtctccttgaagtcatggaagcattcccgtcagctaagccttcacttggtgttttctttgcatctgttgccccgcgcttacaaccaagatactactctatttcttcctcacccaagatggcaccggataggattcatgttacatgtgcattagtctatgagaaaacacctgcaggccgcatccacaaaggagtttgttcaacttggatgaagaacgcagtgcctatgaccgagagtcaagattgcagttgggccccaatatacgtccgaacatccaatttcagactaccatctgaccctaaggtcccggttatcatgattggacctggcactggtttggctccttttagaggtttccttcaagagcggttagctttaaaggaagccggaactgacctcggtttatccattttattcttcggatgtaggaatcgcaaagtggatttcatatatgaaaacgagcttaacaactttgtggagactggtgctctttctgagcttattgttgctttctcccgtgaaggcccgactaaggaatatgtgcaacacaagatgagtgagaaggcttcggatatctggaacttgctttctgaaggagcatatttatacgtatgtggtgatgccaaaggcatggccaaagatgtacatcgaaccctccacacaattgtgcaagaacagggatctcttgactcgtcaaaggcagaactctacgtgaagaatctacaaatgtcaggaagatacctccgtgacgtttggtaa

SEQ ID NO: 25 - protein, 692 aa, Arabidopsis thaliana [sequence omitted]

SEQ ID NO: 26 - protein, 712 aa, Arabidopsis thaliana
MSSSSSSSTSMIDLMAAIIKGEPVIVSDPANASAYESVAAELSSMLIENRQFAMIVTTSIAVLIGCIVMLVWRRSGSGNSKRVEPLKPLVIKPREEEIDDGRKKVTIFFGTQTGTAEGFAKALGEEAKARYEKTRFKIVDLDDYAADDDEYEEKLKKEDVAFFFLATYGDGEPTDNAARFYKWFTEGNDRGEWLKNLKYGVFGLGNRQYEHFNKVAKVVDDILVEQGAQRLVQVGLGDDDQCIEDDFTAWREALWPELDTILREEGDTAVATPYTAAVLEYRVSIHDSEDAKFNDITLANGNGYTVFDAQHPYKANVAVKRELHTPESDRSCIHLEFDIAGSGLTMKLGDHVGVLCDNLSETVDEALRLLDMSPDTYFSLHAEKEDGTPISSSLPPPFPPCNLRTALTRYACLLSSPKKSALVALAAHASDPTEAERLKHLASPAGKDEYSKWVVESQRSLLEVMAEFPSAKPPLGVFFAGVAPRLQPRFYSISSSPKIAETRIHVTCALVYEKMPTGRIHKGVCSTWMKNAVPYEKSEKLFLGRPIFVRQSNFKLPSDSKVPIIMIGPGTGLAPFRGFLQERLALVESGVELGPSVLFFGCRNRRMDFIYEEELQRFVESGALAELSVAFSREGPTKEYVQHKMMDKASDIWNMISQGAYLYVCGDAKGMARDVHRSLHTIAQEQGSMDSTKAEGFVKNLQTSGRYLRDVW

SEQ ID NO: 27 - protein, 709 aa, Stevia rebaudiana
MQSESVEASTIDLMTAVLKDTVIDTANASDNGDSKMPPALAMMFEIRDLLLILTTSVAVLVGCFVVLVWKRSSGKKSGKELEPPKIVVPKRRLEQEVDDGKKKVTIFFGTQTGTAEGFAKALFEEAKARYEKAAFKVIDLDDYAADLDEYAEKLKKETYAFFFLATYGDGEPTDNAAKFYKWFTEGDEKGVWLQKLQYGVFGLGNRQYEHFNKIGIVVDDGLTEQGAKRIVPVGLGDDDQSIEDDFSAWKELVWPELDLLLRDEDDKAAATPYTAAIPEYRVVFHDKPDAFSDDHTQTNGHAVHDAQHPCRSNVAVKKELHTPESDRSCTHLEFDISHTGLSYETGDHVGVYCENLIEVVEEAGKLLGLSTDTYFSLHIDNEDGSPLGGPSLQPPFPPCTLRKALTNYADLLSSPKKSTLLALAAHASDPTEADRLRFLASREGKDEYAEWVVANQRSLLEVMEAFPSARPPLGVFFAAVAPRLQPRYYSISSSPKMEPNRIHVTCALVYEKTPAGRIHKGICSTWMKNAVPLTESQDCSWAPIFVRTSNFRLPIDPKVPVIMIGPGTGLAPFRGFLQERLALKESGTELGSSILFFGCRNRKVDYIYENELNNFVENGALSELDVAFSRDGPTKEYVQHKMTQKASEIWNMLSEGAYLYVCGDAKGMAKDVHRTLHTIVQEQGSLDSSKAELYVKNLQMSGRYLRDVW

SEQ ID NO: 28 - protein, 707 aa, Stevia rebaudiana
MQSNSVKISPLDLVTALFSGKVLDTSNASESGESAMLPTIAMIMENRELLMILTTSVAVLIGCVVVLVWRRSSTKKSALEPPVIVVPKRVQEEEVDDGKKKVTVFFGTQTGTAEGFAKALVEEAKARYEKAVFKVIDLDDYAADDDEYEEKLKKESLAFFFLATYGDGEPTDNAARFYKWFTEGDAKGEWLNKLQYGVFGLGNRQYEHFNKIAKVVDDGLVEQGAKRLVPVGLGDDDQCIEDDFTAWKELVWPELDQLLRDEDDTTVATPYTAAVAEYRVVFHEKPDALSEDYSYTNGHAVHDAQHPCRSNVAVKKELHSPESDRSCTHLEFDISNTGLSYETGDHVGVYCENLSEVVNDAERLVGLPPDTYSSIHTDSEDGSPLGGASLPPPFPPCTLRKALTCYADVLSSPKKSALLALAAHATDPSEADRLKFLASPAGKDEYSQWIVASQRSLLEVMEAFPSAKPSLGVFFASVAPRLQPRYYSISSSPKMAPDRIHVTCALVYEKTPAGRIHKGVCSTWMKNAVPMTESQDCSWAPIYVRTSNFRLPSDPKVPVIMIGPGTGLAPFRGFLQERLALKEAGTDLGLSILFFGCRNRKVDFIYENELNNFVETGALSELIVAFSREGPTKEYVQHKMSEKASDIWNLLSEGAYLYVCGDAKGMAKDVHRTLHTIVQEQGSLDSSKAELYVKNLQMSGRYLRDVW

SEQ ID NO: 29 - protein, 460 aa, Stevia rebaudiana
MAEQQKIKKSPHVLLIPFPLQGHINPFIQFGKRLISKGVKTTLVTTIHTLNSTLNHSNTTTTSIEIQAISDGCDEGGFMSAGESYLETFKQVGSKSLADLIKKLQSEGTTIDAIIYDSMTEWVLDVAIEFGIDGGSFFTQACVVNSLYYHVHKGLISLPLGETVSVPGFPVLQRWETPLILQNHEQIQSPWSQMLFGQFANIDQARWVFTNSFYKLEEEVIEWTRKIWNLKVIGPTLPSMYLDKRLDDDKDNGFNLYKANHHECMNWLDDKPKESVVYVAFGSLVKHGPEQVEEITRALIDSDVNFLWVIKHKEEGKLPENLSEVIKTGKGLIVAWCKQLDVLAHESVGCFVTHCGFNSTLEAISLGVPVVAMPQFSDQTTNAKLLDEILGVGVRVKADENGIVRRGNLASCIKMIMEEERGVIIRKNAVKWKDLAKVAVHEGGSSDNDIVEFVSELIKA

SEQ ID NO: 30 - protein, 481 aa, Stevia rebaudiana
MDAMATTEKKPHVIFIPFPAQSHIKAMLKLAQLLHHKGLQITFVNTDFIHNQFLESSGPHCLDGAPGFRFETIPDGVSHSPEASIPIRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 31 - DNA, 1586 bp, Stevia rebaudiana
atggatgcaatggctacaactgagaagaaaccacacgtcatcttcataccatttccagcacaaagccacattaaagccatgctcaaactagcacaacttctccaccacaaaggactccagataaccttcgtcaacaccgacttcatccacaaccagtttcttgaatcatcgggcccacattgtctagacggtgcaccgggtttccggttcgaaaccattccggatggtgtttctcacagtccggaagcgagcatcccaatcagagaatcactcttgagatccattgaaaccaacttcttggatcgtttcattgatcttgtaaccaaacttccggatcctccgacttgtattatctcagatgggttcttgtcggttttcacaattgacgctgcaaaaaagcttggaattccggtcatgatgtattggacacttgctgcctgtgggttcatgggtttttaccatattcattctctcattgagaaaggatttgcaccacttaaagatgcaagttacttgacaaatgggtatttggacaccgtcattgattgggttccgggaatggaaggcatccgtctcaaggatttcccgctggactggagcactgacctcaatgacaaagttttgatgttcactacggaagctcctcaaaggtcacacaaggtttcacatcatattttccacacgttcgatgagttggagcctagtattataaaaactttgtcattgaggtataatcacatttacaccatcggcccactgcaattacttcttgatcaaatacccgaagagaaaaagcaaactggaattacgagtctccatggatacagtttagtaaaagaagaaccagagtgtttccagtggcttcagtctaaagaaccaaattccgtcgtttatgtaaattttggaagtactacagtaatgtctttagaagacatgacggaatttggttggggacttgctaatagcaaccattatttcctttggatcatccgatcaaacttggtgataggggaaaatgcagttttgccccctgaacttgaggaacatataaagaaaagaggctttattgctagctggtgttcacaagaaaaggtcttgaagcacccttcggttggagggttcttgactcattgtgggtggggatcgaccatcgagagcttgtctgctggggtgccaatgatatgctggccttattcgtgggaccagctgaccaactgtaggtatatatgcaaagaatgggaggttgggctcgagatgggaaccaaagtgaaacgagatgaagtcaagaggcttgtacaagagttgatgggagaaggaggtcacaaaatgaggaacaaggctaaagattggaaagaaaaggctcgcattgcaatagctcctaacggttcatcttctttgaacatagacaaaatggtcaaggaaatcaccgtgctagcaagaaactagttacaaagttgtttcacattgtgctttctatttaagatgtaactttgttctaatttaatattgtctagatgtattgaaccataagtttagttggtctcaggaattgatttttaatgaaataatggtcattaggggtgagt

SEQ ID NO: 32 - DNA, 1446 bp, Artificial Sequence
  Codon optimized nucleotide sequence encoding Stevia rebaudiana UGT85C2
atggatgcaatggcaactactgagaaaaagcctcatgtgatcttcattccatttcctgcacaatctcacataaaggcaatgctaaagttagcacaactattacaccataagggattacagataactttcgtgaataccgacttcatccataatcaatttctggaatctagtggccctcattgtttggacggagccccagggtttagattcgaaacaattcctgacggtgtttcacattccccagaggcctccatcccaataagagagagtttactgaggtcaatagaaaccaactttttggatcgtttcattgacttggtcacaaaacttccagacccaccaacttgcataatctctgatggctttctgtcagtgtttactatcgacgctgccaaaaagttgggtatcccagttatgatgtactggactcttgctgcatgcggtttcatgggtttctatcacatccattctcttatcgaaaagggttttgctccactgaaagatgcatcatacttaaccaacggctacctggatactgttattgactgggtaccaggtatggaaggtataagacttaaagattttcctttggattggtctacagaccttaatgataaagtattgatgtttactacagaagctccacaaagatctcataaggtttcacatcatatctttcacacctttgatgaattggaaccatcaatcatcaaaaccttgtctctaagatacaatcatatctacactattggtccattacaattacttctagatcaaattcctgaagagaaaaagcaaactggtattacatccttacacggctactctttagtgaaagaggaaccagaatgttttcaatggctacaaagtaaagagcctaattctgtggtctacgtcaacttcggaagtacaacagtcatgtccttggaagatatgactgaatttggttggggccttgctaattcaaatcattactttctatggattatcaggtccaatttggtaataggggaaaacgccgtattacctccagaattggaggaacacatcaaaaagagaggtttcattgcttcctggtgttctcaggaaaaggtattgaaacatccttctgttggtggtttccttactcattgcggttggggctctacaatcgaatcactaagtgcaggagttccaatgatttgttggccatattcatgggaccaacttacaaattgtaggtatatctgtaaagagtgggaagttggattagaaatgggaacaaaggttaaacgtgatgaagtgaaaagattggttcaggagttgatgggggaaggtggccacaagatgagaaacaaggccaaagattggaaggaaaaagccagaattgctattgctcctaacgggtcatcctctctaaacattgataagatggtcaaagagattacagtcttagccagaaactaa

SEQ ID NO: 33 - protein, 787 aa, Stevia rebaudiana
MKTGFISPATVFHHRISPATTFRHHLSPATTNSTGIVALRDINFRCKAVSKEYSDLLQKDEASFTKWDDDKVKDHLDTNKNLYPNDEIKEFVESVKAMFGSMNDGEINVSAYDTAWVALVQDVDGSGSPQFPSSLEWIANNQLSDGSWGDHLLFSAHDRIINTLACVIALTSWNVHPSKCEKGLNFLRENICKLEDENAEHMPIGFEVTFPSLIDIAKKLNIEVPEDTPALKEIYARRDIKLTKIPMEVLHKVPTTLLHSLEGMPDLEWEKLLKLQCKDGSFLFSPSSTAFALMQTKDEKCLQYLTNIVTKFNGGVPNVYPVDLFEHIWVVDRLQRLGIARYFKSEIKDCVEYINKYWTKNGICWARNTHVQDIDDTAMGFRVLRAHGYDVTPDVFRQFEKDGKFVCFAGQSTQAVTGMFNVYRASQMLFPGERILEDAKKFSYNYLKEKQSTNELLDKWIIAKDLPGEVGYALDIPWYASLPRLETRYYLEQYGGEDDVWIGKTLYRMGYVSNNTYLEMAKLDYNNYVAVLQLEWYTIQQWYVDIGIEKFESDNIKSVLVSYYLAAASIFEPERSKERIAWAKTTILVDKITSIFDSSQSSKEDITAFIDKFRNKSSSKKHSINGEPWHEVMVALKKTLHGFALDALMTHSQDIHPQLHQAWEMWLTKLQDGVDVTAELMVQMINMTAGRWVSKELLTHPQYQRLSTVTNSVCHDITKLHNFKENSTTVDSKVQELVQLVFSDTPDDLDQDMKQTFLTVMKTFYYKAWCDPNTINDHISKVFEIVI

SEQ ID NO: 34 - protein, 527 aa, Streptomyces clavuligerus
MPDAHDAPPPQIRQRTLVDEATQLLTESAEDAWGEVSVSEYETARLVAHATWLGGHATRVAFLLERQHEDGSWGPPGGYRLVPTLSAVHALLTCLASPAQDHGVPHDRLLRAVDAGLTALRRLGTSDSPPDTIAVELVIPSLLEGIQHLLDPAHPHSRPAFSQHRGSLVCPGGLDGRTLGALRSHAAAGTPVPGKVWHASETLGLSTEAASHLQPAQGIIGGSAAATATWLTRVAPSQQSDSARRYLEELQHRYSGPVPSITPITYFERAWLLNNFAAAGVPCEAPAALLDSLEAALTPQGAPAGAGLPPDADDTAAVLLALATHGRGRRPEVLMDYRTDGYFQCFIGERTPSISTNAHVLETLGHHVAQHPQDRARYGSAMDTASAWLLAAQKQDGSWLDKWHASPYYATVCCTQALAAHASPATAPARQRAVRWVLATQRSDGGWGLWHSTVEETAYALQILAPPSGGGNIPVQQALTRGRARLCGALPLTPLWHDKDLYTPVRVVRAARAAALYTTRDLLLPPL

SEQ ID NO: 35 - protein, 516 aa, Bradyrhizobium diazoefficiens
MNALSEHILSELRRLLSEMSDGGSVGPSVYDTAQALRFHGNVTGRQDAYAWLIAQQQADGGWGSADFPLFRHAPTWAALLALQRADPLPGAADAVQTATRFLQRQPDPYAHAVPEDAPIGAELILPQFCGEAAWLLGGVAFPRHPALLPLRQACLVKLGAVAMLPSGHPLLHSWEAWGTSPTTACPDDDGSIGISPAATAAWRAQAVTRGSTPQVGRADAYLQMASRATRSGIEGVFPNVWPINVFEPCWSLYTLHLAGLFAHPALAEAVRVIVAQLEARLGVHGLGPALHFAADADDTAVALCVLHLAGRDPAVDALRHFEIGELFVTFPGERNASVSTNIHALHALRLLGKPAAGASAYVEANRNPHGLWDNEKWHVSWLYPTAHAVAALAQGKPQWRDERALAALLQAQRDDGGWGAGRGSTFEETAYALFALHVMDGSEEATGRRRIAQVVARALEWMLARHAAHGLPQTPLWIGKELYCPTRVVRVAELAGLWLALRWGRRVLAEGAGAAP

SEQ ID NO: 36 - DNA, 4577 bp, Zea mays
gacctgaccaccaccccccggccggccctttcattctttccttactttcttcctcctgctgctcttgccgtttcagtgattattagctgctgtacgtgcgtgcgtacattgttctctctgctgacacccatacacgctgtagcttctacacataccagttcgatcgcaagctatagcatggggcttcaatcatcgcccatgctgctgccagcgccgacggcaacggcggccggcagcgggtcacagtggcgcacggctgtggcgggtaatggtaactcgtttatcttcttctacacgtaatctctattatatacctagattttctccacaggcagatcagattctttacacagctgtattctcaaaaaaaactcatagaaaaaaaagaaaaaactaaaccaaaggagcgacctcaacctgtaccagtgcccctgctagcagtagcttcgttctgtcccttttttttcatttggatcctctacataaatgctgggtggtggtgtcctttcacgcacacatccgcagatagcgccccagcagcatttatgtggggacgacggctctgaaatgaattactagtcagtttcatgcgtttcagtgcgagtattatagtagtagatctcttctccgatatatccggccaaaggaagaagagaagagaaaccacacatctcattctcaactagtagtagaaaagtaaaaacgtactacaagcgcaagcgcaaagatggttctttcatcgtcttgcacaacagttcctcacctttcttcccttgcggtcgttcaactaggcccatggagttcccgcatcaagaagaagacggatacagtcgccgtccccgcggccgccggccggtggaggagggcactggcgcgggcccagcacaccagcgaatccgccgccgtcgccaaaggtacgggtgatcgctagctttgatagctccaaatctgagcagcaaattaaatagctaggtttgtaacgcacgcacgcatgcaggttcgtccctaacgcccatcgtgagaaccgatgccgaaagccgccgcacgagatggcctacggacgacgacgacgctgagccgctggtcgacgagatcagggcaatgctgacgtcgatgagcgacggggacatcagcgtgtcggcgtacgacaccgcctgggtgggtcttgtgcccaggctggacggcggcgagggcccgcagttcccggccgccgtgcggtggatccggaacaaccagctccccgacggctcgtggggcgacgcggccctgttctccgcgtacgaccgcctgatcaacacgctggcgtgcgtcgtcacgctcaccaggtggtcgctggagcccgagatgcgcggcagaggtacgtaattactgtgtgctggccgatcgagagaacacacgacggcagtgtacctcgacagaaaacgggcgttgctgaagactcaagtgtgtgtgtgtgtgtgttcacagggctctctttcctcggccggaacatgtggaagctagcgacggaggacgaggagtccatgccgatagggttcgagctcgcgttcccttctctcatcgaactagccaagagtctgggcgtccacgacttcccgtacgaccaccaggctctgcagggaatatactcgagcagggagatcaagatgaagaggattcctaaggaagtgatgcacacggttcccacatccattctccacagcctggaagggatgcccgggctagactgggcgaagctgctgaaactgcagtcgagcgacgggtccttcctcttctctcccgcggccaccgcgtacgctctcatgaacaccggcgacgacaggtgcttcagctacatcgacaggacagtcaagaaattcaacggaggaggtacgcaagcagtagcgtagatacatgggcatagcatgcatgcatgcaatgcagcgttgcccactgcatgcgccttccttccttccttctcgtctcttcaacggttcgtcttctctcgccgtttctcgcagtgcccaacgtctaccccgtggaccttttcgagcacatatgggctgtcgatcgcctggagcgtctcgggatctcccgctacttccagaaagagattgagcagtgcatggactacgtgaacaggcactggactgaggacgggatctgctgggcgaggaactccgacgtgaaggaggtggacgacacggccatggctttccgcctgctacggctgcacggatacagcgtctcgccaggtacgtaacaaacacaaaaaaaaaaaacgcgcagacaacagagatcgtcacgtcatacacacgcgtgtcctgaacatttttcatttggtctcccacccatcgtacgtaataataataaaaaaaaacgtgcttctgccctgcctgtgtacgtgtagatgtgttcaagaacttcgagaaggacggggagttcttcgccttcgtggggcagtcgaaccaggcggtgacggggatgtacaacctcaacagggcctcccagataagcttcccgggggaggacgtcctgcaccgtgcaggggctttctcgtacgagtttctcaggcggaaagaggccgagggagcgctccgtgacaaatggatcatatctaaggacctgcctggggaggtagtgtacaccctggacttcccttggtatgggaacctgccgcgcgtggaggcgagagactatctggaacagtacggcggcggcgacgatgtctggatcgggaagacgctctacaggtagatagatctttttagctattaattggtttcagatcgaccagataaaatttgcattattggttcttttgatgcatgtaattgaaagccaataaataacctcagtatgcgtgatggctgacttttgcattggcaggatgcctcttgtgaataacgatgtgtatcttgagctggctaggatggacttcaaccattgccaagccctacatcagcttgagtggcaaggcctgaaaaggtatgtatgttactatatatatacagcccggttgttgagttttttttttattttatttttttcgcgattaccatttcttctcgatgcaaaataaatctgcacagatcatcatatatatccttgatgatatataagggcttctcgtatatatatcttatcacctatatatacataggtggtacactgagaaccggctcatggatttcggagtggcgcaagaggatgctctgcgagcgtatttcctggccgccgcttccgtctacgagccgtgccgagccgcggagcggcttgcgtgggccagagcggcgatacttgccaacgccgtctctacccatctccgtaacagcccctcattcagagaacgcttggaacactccttgcgttgccgccccagtgaagaaacggatggatcatggtaataagctgatcgatgggaaattaaaaatttaagttttttttttcttttttgttgccattatctgagaccaatgcaatgtggtgcatatatatccaggttcaactcatcaagtggaagtgacgctgttcttgtgaaggcagttctgcggcttaccgactcgttagcgcgagaagcgcagccgattcatggcggtgatccggaggacatcatccacaagctactgagatcagctgtaagttaaacgtaacgttcagaagaagatttttttttttttttgcagttaacaagtactacgacatctatcgtttttgttcagcatgcacagtcatcctagctactaataccattattcttctgtgaacttgtgtagtgggctgaatgggtcagggagaaggcagatgcagcagacagcgtgtgtaatggatccagtgctgtggaacaagaagggtcgcgcatggttcatgacaagcaaacgtgtctgcttttagctcgaatgatcgagatcagcgctgggcgagctgcaggtgaggctgcgagcgaagatggtgaccgtcggattatccagctcactgggtctatatgtgacagtctcaagcagaagatgctagtatctcaggtatagcacatatatactacagaaagtttgtgcgtagttattatttcccttttttcatgtgacgaacatgatgacctgatgatgcatgtatatggcttcatataggaccccgagaagaacgaagagatgatgagccatgtcgatgacgaattgaagctgcgtatacgagagttcgttcagtatcttctgagactcggtgagaagaaaaccggcagcagcgagacaaggcagacctttctgagcatcgtgaaaagctgttactacgctgctcactgcccgccgcatgtggtagacaggcatatttccagagttatttttgaacctgtttccgccgcaaaataatggtaatggtagatgtgaatgtgatatggagataagagagagagaaaatgttgatagtggaaattggcgttgatgtcgcctccacattctttacgcaaaagtagcgtctgttttggataaaaaaaatccagtttctgtaaattatagaataaatcaatcgctgtgtcccaaactctaaaatgttattctgtgaagtatggaataaatcggtcactatacctatcttgtggatgc

SEQ ID NO: 37 - protein, 827 aa, Zea mays
MVLSSSCTTVPHLSSLAVVQLGPWSSRIKKKTDTVAVPAAAGRWRRALARAQHTSESAAVAKGSSLTPIVRTDAESRRTRWPTDDDDAEPLVDEIRAMLTSMSDGDISVSAYDTAWVGLVPRLDGGEGPQFPAAVRWIRNNQLPDGSWGDAALFSAYDRLINTLACVVTLTRWSLEPEMRGRGLSFLGRNMWKLATEDEESMPIGFELAFPSLIELAKSLGVHDFPYDHQALQGIYSSREIKMKRIPKEVMHTVPTSILHSLEGMPGLDWAKLLKLQSSDGSFLFSPAATAYALMNTGDDRCFSYIDRTVKKFNGGVPNVYPVDLFEHIWAVDRLERLGISRYFQKEIEQCMDYVNRHWTEDGICWARNSDVKEVDDTAMAFRLLRLHGYSVSPDVFKNFEKDGEFFAFVGQSNQAVTGMYNLNRASQISFPGEDVLHRAGAFSYEFLRRKEAEGALRDKWIISKDLPGEVVYTLDFPWYGNLPRVEARDYLEQYGGGDDVWIGKTLYRMPLVNNDVYLELARMDFNHCQALHQLEWQGLKRWYTENRLMDFGVAQEDALRAYFLAAASVYEPCRAAERLAWARAAILANAVSTHLRNSPSFRERLEHSLRCRPSEETDGSWFNSSSGSDAVLVKAVLRLTDSLAREAQPIHGGDPEDIIHKLLRSAWAEWVREKADAADSVCNGSSAVEQEGSRMVHDKQTCLLLARMIEISAGRAAGEAASEDGDRRIIQLTGSICDSLKQKMLVSQDPEKNEEMMSHVDDELKLRIREFVQYLLRLGEKKTGSSETRQTFLSIVKSCYYAAHCPPHVVDRHISRVIFEPVSAAK

SEQ ID NO: 38 - DNA, 2570 bp, Arabidopsis thaliana
cttcttcactaaatacttagacagagaaaacagagctttttaaagccatgtctcttcagtatcatgttctaaactccattccaagtacaacctttctcagttctactaaaacaacaatatcttcttctttccttaccatctcaggatctcctctcaatgtcgctagagacaaatccagaagcggttccatacattgttcaaagcttcgaactcaagaatacattaattctcaagaggttcaacatgatttgcctctaatacatgagtggcaacagcttcaaggagaagatgctcctcagattagtgttggaagtaatagtaatgcattcaaagaagcagtgaagagtgtgaaaacgatcttgagaaacctaacggacggggaaattacgatatcggcttacgatacagcttgggttgcattgatcgatgccggagataaaactccggcgtttccctccgccgtgaaatggatcgccgagaaccaactttccgatggttcttggggagatgcgtatctcttctcttatcatgatcgtctcatcaatacccttgcatgcgtcgttgctctaagatcatggaatctctttcctcatcaatgcaacaaaggaatcacgtttttccgggaaaatattgggaagctagaagacgaaaatgatgagcatatgccaatcggattcgaagtagcattcccatcgttgcttgagatagctcgaggaataaacattgatgtaccgtacgattctccggtcttaaaagatatatacgccaagaaagagctaaagcttacaaggataccaaaagagataatgcacaagataccaacaacattgttgcatagtttggaggggatgcgtgatttagattgggaaaagctcttgaaacttcaatctcaagacggatctttcctcttctctccttcctctaccgcttttgcattcatgcagacccgagacagtaactgcctcgagtatttgcgaaatgccgtcaaacgtttcaatggaggagttcccaatgtctttcccgtggatcttttcgagcacatatggatagtggatcggttacaacgtttagggatatcgagatactttgaagaagagattaaagagtgtcttgactatgtccacagatattggaccgacaatggcatatgttgggctagatgttcccatgtccaagacatcgatgatacagccatggcatttaggctcttaagacaacatggataccaagtgtccgcagatgtattcaagaactttgagaaagagggagagtttttctgctttgtggggcaatcaaaccaagcagtaaccggtatgttcaacctataccgggcatcacaattggcgtttccaagggaagagatattgaaaaacgccaaagagttttcttataattatctgctagaaaaacgggagagagaggagttgattgataagtggattataatgaaagacttacctggcgagattgggtttgcgttagagattccatggtacgcaagcttgcctcgagtagagacgagattctatattgatcaatatggtggagaaaacgacgtttggattggcaagactctttataggatgccatacgtgaacaataatggatatctggaattagcaaaacaagattacaacaattgccaagctcagcatcagctcgaatgggacatattccaaaagtggtatgaagaaaataggttaagtgagtggggtgtgcgcagaagtgagcttctcgagtgttactacttagcggctgcaactatatttgaatcagaaaggtcacatgagagaatggtttgggctaagtcaagtgtattggttaaagccatttcttcttcttttggggaatcctctgactccagaagaagcttctccgatcagtttcatgaatacattgccaatgctcgacgaagtgatcatcactttaatgacaggaacatgagattggaccgaccaggatcggttcaggccagtcggcttgccggagtgttaatcgggactttgaatcaaatgtcttttgaccttttcatgtctcatggccgtgacgttaacaatctcctctatctatcgtggggagattggatggaaaaatggaaactatatggagatgaaggagaaggagagctcatggtgaagatgataattctaatgaagaacaatgacctaactaacttcttcacccacactcacttcgttcgtctcgcggaaatcatcaatcgaatctgtcttcctcgccaatacttaaaggcaaggagaaacgatgagaaggagaagacaataaagagtatggagaaggagatggggaaaatggttgagttagcattgtcggagagtgacacatttcgtgacgtcagcatcacgtttcttgatgtagcaaaagcattttactactttgctttatgtggcgatcatctccaaactcacatctccaaagtcttgtttcaaaaagtctagtaacctcatcatcatcatcgatccattaacaatcagtggatcgatgtatccatagatgcgtgaataatatttcatgtagagaaggagaacaaattagatcatgtagggttatca

SEQ ID NO: 39 - protein, 802 aa, Arabidopsis thaliana
MSLQYHVLNSIPSTTFLSSTKTTISSSFLTISGSPLNVARDKSRSGSIHCSKLRTQEYINSQEVQHDLPLIHEWQQLQGEDAPQISVGSNSNAFKEAVKSVKTILRNLTDGEITISAYDTAWVALIDAGDKTPAFPSAVKWIAENQLSDGSWGDAYLFSYHDRLINTLACVVALRSWNLFPHQCNKGITFFRENIGKLEDENDEHMPIGFEVAFPSLLEIARGINIDVPYDSPVLKDIYAKKELKLTRIPKEIMHKIPTTLLHSLEGMRDLDWEKLLKLQSQDGSFLFSPSSTAFAFMQTRDSNCLEYLRNAVKRFNGGVPNVFPVDLFEHIWIVDRLQRLGISRYFEEEIKECLDYVHRYWTDNGICWARCSHVQDIDDTAMAFRLLRQHGYQVSADVFKNFEKEGEFFCFVGQSNQAVTGMFNLYRASQLAFPREEILKNAKEFSYNYLLEKREREELIDKWIIMKDLPGEIGFALEIPWYASLPRVETRFYIDQYGGENDVWIGKTLYRMPYVNNNGYLELAKQDYNNCQAQHQLEWDIFQKWYEENRLSEWGVRRSELLECYYLAAATIFESERSHERMVWAKSSVLVKAISSSFGESSDSRRSFSDQFHEYIANARRSDHHFNDRNMRLDRPGSVQASRLAGVLIGTLNQMSFDLFMSHGRDVNNLLYLSWGDWMEKWKLYGDEGEGELMVKMIILMKNNDLTNFFTHTHFVRLAEIINRICLPRQYLKARRNDEKEKTIKSMEKEMGKMVELALSESDTFRDVSITFLDVAKAFYYFALCGDHLQTHISKVLFQKV

SEQ ID NO: 40 - protein, 983 aa, Diaporthe amygdali
MEFDEPLVDEARSLVQRTLQDYDDRYGFGTMSCAAYDTAWVSLVTKTVDGRKQWLFPECFEFLLETQSDAGGWEIGNSAPIDGILNTAASLLALKRHVQTEQIIQPQHDHKDLAGRAERAAASLRAQLAALDVSTTEHVGFEIIVPAMLDPLEAEDPSLVFDFPARKPLMKIHDAKMSRFRPEYLYGKQPMTALHSLEAFIGKIDFDKVRHHRTHGSMMGSPSSTAAYLMHASQWDGDSEAYLRHVIKHAAGQGTGAVPSAFPSTHFESSWILTTLFRAGFSASHLACDELNKLVEILEGSFEKEGGAIGYAPGFQADVDDTAKTISTLAVLGRDATPRQMIKVFEANTHFRTYPGERDPSLTANCNALSALLHQPDAAMYGSQIQKITKFVCDYWWKSDGKIKDKWNTCYLYPSVLLVEVLVDLVSLLEQGKLPDVLDQELQYRVAITLFQACLRPLLDQDAEGSWNKSIEATAYGILILTEARRVCFFDRLSEPLNEAIRRGIAFADSMSGTEAQLNYIWIEKVSYAPALLTKSYLLAARWAAKSPLGASVGSSLWTPPREGLDKHVRLFHQAELFRSLPEWELRASMIEAALFTPLLRAHRLDVFPRQDVGEDKYLDVVPFFWTAANNRDRTYASTLFLYDMCFIAMLNFQLDEFMEATAGILFRDHMDDLRQLIHDLLAEKTSPKSSGRSSQGTKDADSGIEEDVSMSDSASDSQDRSPEYDLVFSALSTFTKHVLQHPSIQSASVWDRKLLAREMKAYLLAHIQQAEDSTPLSELKDVPQKTDVTRVSTSTTTFFNWVRTTSADHISCPYSFHFVACHLGAALSPKGSNGDCYPSAGEKFLAAAVCRHLATMCRMYNDLGSAERDSDEGNLNSLDFPEFADSAGNGGIEIQKAALLRLAEFERDSYLEAFRRLQDESNRVHGPAGGDEARLSRRRMAILEFFAQQVDLYGQVYVIRDISARIPKNEVEKKRKLDDAFN

SEQ ID NO: 41 - protein, 881 aa, Physcomitrella patens
MASSTLIQNRSCGVTSSMSSFQIFRGQPLRFPGTRTPAAVQCLKKRRCLRPTESVLESSPGSGSYRIVTGPSGINPSSNGHLQEGSLTHRLPIPMEKSIDNFQSTLYVSDIWSETLQRTECLLQVTENVQMNEWIEEIRMYFRNMTLGEISMSPYDTAWVARVPALDGSHGPQFHRSLQWIIDNQLPDGDWGEPSLFLGYDRVCNTLACVIALKTWGVGAQNVERGIQFLQSNIYKMEEDDANHMPIGFEIVFPAMMEDAKALGLDLPYDATILQQISAEREKKMKKIPMAMVYKYPTTLLHSLEGLHREVDWNKLLQLQSENGSFLYSPASTACALMYTKDVKCFDYLNQLLIKFDHACPNVYPVDLFERLWMVDRLQRLGISRYFEREIRDCLQYVYRYWKDCGIGWASNSSVQDVDDTAMAFRLLRTHGFDVKEDCFRQFFKDGEFFCFAGQSSQAVTGMFNLSRASQTLFPGESLLKKARTFSRNFLRTKHENNECFDKWIITKDLAGEVEYNLTFPWYASLPRLEHRTYLDQYGIDDIWIGKSLYKMPAVTNEVFLKLAKADFNMCQALHKKELEQVIKWNASCQFRDLEFARQKSVECYFAGAATMFEPEMVQARLVWARCCVLTTVLDDYFDHGTPVEELRVFVQAVRTWNPELINGLPEQAKILFMGLYKTVNTIAEEAFMAQKRDVHHHLKHYWDKLITSALKEAEWAESGYVPTFDEYMEVAEISVALEPIVCSTLFFAGHRLDEDVLDSYDYHLVMHLVNRVGRILNDIQGMKREASQGKISSVQIYMEEHPSVPSEAMAIAHLQELVDNSMQQLTYEVLRFTAVPKSCKRIHLNMAKIMHAFYKDTDGFSSLTAMTGFVKKVLFEPVPE

SEQ ID NO: 42 - protein, 952 aa, Fusarium fujikuroi
MPGKIENGTPKDLKTGNDFVSAAKSLLDRAFKSHHSYYGLCSTSCQVYDTAWVAMIPKTRDNVKQWLFPECFHYLLKTQAADGSWGSLPTTQTAGILDTASAVLALLCHAQEPLQILDVSPDEMGLRIEHGVTSLKRQLAVWNDVEDTNHIGVEFIIPALLSMLEKELDVPSFEFPCRSILERMHGEKLGHFDLEQVYGKPSSLLHSLEAFLGKLDFDRLSHHLYHGSMMASPSSTAAYLIGATKWDDEAEDYLRHVMRNGAGHGNGGISGTFPTTHFECSWIIATLLKVGFTLKQIDGDGLRGLSTILLEALRDENGVIGFAPRTADVDDTAKALLALSLVNQPVSPDIMIKVFEGKDHFTTFGSERDPSLTSNLHVLLSLLKQSNLSQYHPQILKTTLFTCRWWWGSDHCVKDKWNLSHLYPTMLLVEAFTEVLHLIDGGELSSLFDESFKCKIGLSIFQAVLRIILTQDNDGSWRGYREQTCYAILALVQARHVCFFTHMVDRLQSCVDRGFSWLKSCSFHSQDLTWTSKTAYEVGFVAEAYKLAALQSASLEVPAATIGHSVTSAVPSSDLEKYMRLVRKTALFSPLDEWGLMASIIESSFFVPLLQAQRVEIYPRDNIKVDEDKYLSIIPFTWVGCNNRSRTFASNRWLYDMMYLSLLGYQTDEYMEAVAGPVFGDVSLLHQTIDKVIDNTMGNLARANGTVHSGNGHQHESPNIGQVEDTLTRFTNSVLNHKDVLNSSSSDQDTLRREFRTFMHAHITQIEDNSRFSKQASSDAFSSPEQSYFQWVNSTGGSHVACAYSFAFSNCLMSANLLQGKDAFPSGTQKYLISSVMRHATNMCRMYNDFGSIARDNAERNVNSIHFPEFTLCNGTSQNLDERKERLLKIATYEQGYLDRALEALERQSRDDAGDRAGSKDMRKLKIVKLFCDVTDLYDQLYVIKDLSSSMK

SEQ ID NO: 43 - protein, 361 aa, Stevia rebaudiana
MALVNPTALFYGTSIRTRPTNLLNPTQKLRPVSSSSLPSFSSVSAILTEKHQSNPSENNNLQTHLETPFNFDSYMLEKVNMVNEALDASVPLKDPIKIHESMRYSLLAGGKRIRPMMCIAACEIVGGNILNAMPAACAVEMIHTMSLVHDDLPCMDNDDFRRGKPISHKVYGEEMAVLTGDALLSLSFEHIATATKGVSKDRIVRAIGELARSVGSEGLVAGQVVDILSEGADVGLDHLEYIHIHKTAMLLESSVVIGAIMGGGSDQQIEKLRKFARSIGLLFQVVDDILDVTKSTEELGKTAGKDLLTDKTTYPKLLGIEKSREFAEKLNKEAQEQLSGFDRRKAAPLIALANYNAYRQN

SEQ ID NO: 44 - protein, 342 aa, Fusarium fujikuroi
MAEQQISNLLSMFDASHASQKLEITVQMMDTYHYRETPPDSSSSEGGSLSRYDERRVSLPLSHNAASPDIVSQLCFSTAMSSELNHRWKSQRLKVADSPYNYILTLPSKGIRGAFIDSLNVWLEVPEDETSVIKEVIGMLHNSSLIIDDFQDNSPLRRGKPSTHTVFGPAQAINTATYVIVKAIEKIQDIVGHDALADVTGTITTIFQGQAMDLWWTANAIVPSIQEYLLMVNDKTGALFRLSLELLALNSEASISDSALESLSSAVSLLGQYFQIRDDYMNLIDNKYTDQKGFCEDLDEGKYSLTLIHALQTDSSDLLTNILSMRRVQGKLTAQKRCWFWK

SEQ ID NO: 45 - protein, 300 aa, Mus musculus
MEKTKEKAERILLEPYRYLLQLPGKQVRSKLSQAFNHWLKVPEDKLQIIIEVTEMLHNASLLIDDIEDSSKLRRGFPVAHSIYGVPSVINSANYVYFLGLEKVLTLDHPDAVKLFTRQLLELHQGQGLDIYWRDTYTCPTEEEYKAMVLQKTGGLFGLAVGLMQLFSDYKEDLKPLLDTLGLFFQIRDDYANLHSKEYSENKSFCEDLTEGKFSFPTIHAIWSRPESTQVQNILRQRTENIDIKKYCVQYLEDVGSFAYTRHTLRELEAKAYKQIEACGGNPSLVALVKHLSKMFTEENK

SEQ ID NO: 46 - protein, 339 aa, Thalassiosira pseudonana
MARFYFLNALLMVISLQSTTAFTPAKLAYPTTTTALNVASAETSFSLDEYLASKIGPIESALEASVKSRIPQTDKICESMAYSLMAGGKRIRPVLCIAACEMFGGSQDVAMPTAVALEMIHTMSLIHDDLPSMDNDDLRRGKPTNHVVFGEDVAILAGDSLLSTSFEHVARETKGVSAEKIVDVIARLGKSVGAEGLAGGQVMDLECEAKPGTTLDDLKWIHIHKTATLLQVAVASGAVLGGATPEEVAACELFAMNIGLAFQVADDILDVTASSEDLGKTAGKDEATDKTTYPKLLGLEESKAYARQLIDEAKESLAPFGDRAAPLLAIADFIIDRKN

SEQ ID NO: 47 - protein, 355 aa, Streptomyces clavuligerus
MHLAPRRVPRGRRSPPDRVPERQGALGRRRGAGSTGCARAAAGVHRRRGGGEADPSAAVHRGWQAGGGTGLPDEVVSTAAALEMFHAFALIHDDIMDDSATRRGSPTVHRALADRLGAALDPDQAGQLGVSTAILVGDLALTWSDELLYAPLTPHRLAAVLPLVTAMRAETVHGQYLDITSARRPGTDTSLALRIARYKTAAYTMERPLHIGAALAGARPELLAGLSAYALPAGEAFQLADDLLGVFGDPRRTGKPDLDDLRGGKHTVLVALAREHATPEQRHTLDTLLGTPGLDRQGASRLRCVLVATGARAEAERLITERRDQALTALNALTLPPPLAEALARLTLGSTAHPA

SEQ ID NO: 48 - protein, 330 aa, Sulfolobus acidocaldarius
MSYFDNYFNEIVNSVNDIIKSYISGDVPKLYEASYHLFTSGGKRLRPLILTISSDLFGGQRERAYYAGAAIEVLHTFTLVHDDIMDQDNIRRGLPTVHVKYGLPLAILAGDLLHAKAFQLLTQALRGLPSETIIKAFDIFTRSIIIISEGQAVDMEFEDRIDIKEQEYLDMISRKTAALFSASSSIGALIAGANDNDVRLMSDFGTNLGIAFQIVDDILGLTADEKELGKPVFSDIREGKKTILVIKTLELCKEDEKKIVLKALGNKSASKEELMSSADIIKKYSLDYAYNLAEKYYKNAIDSLNQVSSKSDIPGKALKYLAEFTIRRRK

SEQ ID NO: 49 - protein, 297 aa, Synechococcus sp.
MVAQTFNLDTYLSQRQQQVEEALSAALVPAYPERIYEAMRYSLLAGGKRLRPILCLAACELAGGSVEQAMPTACALEMIHTMSLIHDDLPAMDNDDFRRGKPTNHKVFGEDIAILAGDALLAYAFEHIASQTRGVPPQLVLQVIARIGHAVAATGLVGGQVVDLESEGKAISLETLEYIHSHKTGALLEASVVSGGILAGADEELLARLSHYARDIGLAFQIVDDILDVTATSEQLGKTAGKDQAAAKATYPSLLGLEASRQKAEELIQSAKEALRPYGSQAEPLLALADFITRRQH

SEQ ID NO: 50 - protein, 371 aa, Arabidopsis thaliana
MASVTLGSWIVVHHHNHHHPSSILTKSRSRSCPITLTKPISFRSKRTVSSSSSIVSSSVVTKEDNLRQSEPSSFDFMSYIITKAELVNKALDSAVPLREPLKIHEAMRYSLLAGGKRVRPVLCIAACELVGGEESTAMPAACAVEMIHTMSLIHDDLPCMDNDDLRRGKPTNHKVFGEDVAVLAGDALLSFAFEHLASATSSDVVSPVRVVRAVGELAKAIGTEGLVAGQVVDISSEGLDLNDVGLEHLEFIHLHKTAALLEASAVLGAIVGGGSDDEIERLRKFARCIGLLFQVVDDILDVTKSSKELGKTAGKDLIADKLTYPKIMGLEKSREFAEKLNREARDQLLGFDSDKVAPLLALANYIAYRQN

SEQ ID NO: 51 - protein, 462 aa, Oryza sativa
MDSGYSSSYAAAAGMHVVICPWLAFGHLLPCLDLAQRLASRGHRVSFVSTPRNISRLPPVRPALAPLVAFVALPLPRVEGLPDGAESTNDVPHDRPDMVELHRRAFDGLAAPFSEFLGTACADWVIVDVFHHWAAAAALEHKVPCAMMLLGSAHMIASIADRRLERAETESPAAAGQGRPAAAPTFEVARMKLIRTKGSSGMSLAERFSLTLSRSSLVVGRSCVEFEPETVPLLSTLRGKPITFLGLMPPLHEGRREDGEDATVRWLDAQPAKSVVYVALGSEVPLGVEKVHELALGLELAGTRFLWALRKPTGVSDADLLPAGFEERTRGRGVVATRWVPQMSILAHAAVGAFLTHCGWNSTIEGLMFGHPLIMLPIFGDQGPNARLIEAKNAGLQVARNDGDGSFDREGVAAAIRAVAVEEESSKVFQAKAKKLQEIVADMACHERYIDGFIQQLRSYKD

SEQ ID NO: 52 - DNA, 1389 bp, Oryza sativa
atggactccggctactcctcctcctacgccgccgccgccgggatgcacgtcgtgatctgcccgtggctcgccttcggccacctgctcccgtgcctcgacctcgcccagcgcctcgcgtcgcggggccaccgcgtgtcgttcgtctccacgccgcggaacatatcccgcctcccgccggtgcgccccgcgctcgcgccgctcgtcgccttcgtggcgctgccgctcccgcgcgtcgaggggctccccgacggcgccgagtccaccaacgacgtcccccacgacaggccggacatggtcgagctccaccggagggccttcgacgggctcgccgcgcccttctcggagttcttgggcaccgcgtgcgccgactgggtcatcgtcgacgtcttccaccactgggccgcagccgccgctctcgagcacaaggtgccatgtgcaatgatgttgttgggctctgcacatatgatcgcttccatagcagacagacggctcgagcgcgcggagacagagtcgcctgcggctgccgggcagggacgcccagcggcggcgccaacgttcgaggtggcgaggatgaagttgatacgaaccaaaggctcatcgggaatgtccctcgccgagcgcttctccttgacgctctcgaggagcagcctcgtcgtcgggcggagctgcgtggagttcgagccggagaccgtcccgctcctgtcgacgctccgcggtaagcctattaccttccttggccttatgccgccgttgcatgaaggccgccgcgaggacggcgaggatgccaccgtccgctggctcgacgcgcagccggccaagtccgtcgtgtacgtcgcgctaggcagcgaggtgccactgggagtggagaaggtccacgagctcgcgctcgggctggagctcgccgggacgcgcttcctctgggctcttaggaagcccactggcgtctccgacgccgacctcctccccgccggcttcgaggagcgcacgcgcggccgcggcgtcgtggcgacgagatgggttcctcagatgagcatactggcgcacgccgccgtgggcgcgttcctgacccactgcggctggaactcgaccatcgaggggctcatgttcggccacccgcttatcatgctgccgatcttcggcgaccagggaccgaacgcgcggctaatcgaggcgaagaacgccggattgcaggtggcaagaaacgacggcgatggatcgttcgaccgagaaggcgtcgcggcggcgattcgtgcagtcgcggtggaggaagaaagcagcaaagtgtttcaagccaaagccaagaagctgcaggagatcgtcgcggacatggcctgccatgagaggtacatcgacggattcattcagcaattgagatcttacaaggattga

SEQ ID NO: 53 - DNA, 1389 bp, Artificial Sequence
  Codon optimized Oryza sativa sequence encoding EUGT11
atggatagtggctactcctcatcttatgctgctgccgctggtatgcacgttgtgatctgcccttggttggcctttggtcacctgttaccatgtctggatttagcccaaagactggcctcaagaggccatagagtatcatttgtgtctactcctagaaatatctctcgtttaccaccagtcagacctgctctagctcctctagttgcattcgttgctcttccacttccaagagtagaaggattgccagacggcgctgaatctactaatgacgtaccacatgatagacctgacatggtcgaattgcatagaagagcctttgatggattggcagctccattttctgagttcctgggcacagcatgtgcagactgggttatagtcgatgtatttcatcactgggctgctgcagccgcattggaacataaggtgccttgtgctatgatgttgttagggtcagcacacatgatcgcatccatagctgatagaagattggaaagagctgaaacagaatccccagccgcagcaggacaaggtaggccagctgccgccccaacctttgaagtggctagaatgaaattgattcgtactaaaggtagttcagggatgagtcttgctgaaaggttttctctgacattatctagatcatcattagttgtaggtagatcctgcgtcgagttcgaacctgaaacagtacctttactatctactttgagaggcaaacctattactttccttggtctaatgcctccattacatgaaggaaggagagaagatggtgaagatgctactgttaggtggttagatgcccaacctgctaagtctgttgtttacgttgcattgggttctgaggtaccactaggggtggaaaaggtgcatgaattagcattaggacttgagctggccggaacaagattcctttgggctttgagaaaaccaaccggtgtttctgacgccgacttgctaccagctgggttcgaagagagaacaagaggccgtggtgtcgttgctactagatgggtcccacaaatgagtattctagctcatgcagctgtaggggcctttctaacccattgcggttggaactcaacaatagaaggactgatgtttggtcatccacttattatgttaccaatctttggcgatcagggacctaacgcaagattgattgaggcaaagaacgcaggtctgcaggttgcacgtaatgatggtgatggttcctttgatagagaaggcgttgcagctgccatcagagcagtcgccgttgaggaagagtcatctaaagttttccaagctaaggccaaaaaattacaagagattgtggctgacatggcttgtcacgaaagatacatcgatggtttcatccaacaattgagaagttataaagactaa

SEQ ID NO: 54 - protein, 473 aa, Artificial Sequence
  UGT91D2e
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLVPYKAPGISDGYRMGLVLKGSDCLLSKCYHEFGTQWLPLLETLHQVPVVPVGLLPPEIPGDEKDETWVSIKKWLDGKQKGSVVYVALGSEVLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNARAVAIDHES

SEQ ID NO: 55 - protein, 473 aa, Artificial Sequence
  UGT91D2m
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLVPYKAPGISDGYRMGLVLKGSDCLLSKCYHEFGTQWLPLLETLHQVPVVPVGLLPPEVPGDEKDETWVSIKKWLDGKQKGSVVYVALGSEVLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNTRAVAIDHES

SEQ ID NO: 56 - protein, 459 aa, Ipomoea purpurea
MGSQATTYHMAMYPWFGVGHLTGFFRLANKLAGKGHRISFLIPKNTQSKLESFNLHPHLISFVPIVVPSIPGLPPGAETTSDVPFPSTHLLMEAMDKTQNDIEIILKDLKVDVVFYDFTHWLPSLARKIGIKSVFYSTISPLMHGYALSPERRVVGKQLTEADMMKAPASFPDPSIKLHAHEARGFTARTVMKFGGDITFFDRIFTAVSESDGLAYSTCREIEGQFCDYIETQFQKPVLLAGPALPVPSKSTMEQKWSDWLGKFKEGSVIYCAFGSECTLRKDKFQELLWGLELTGMPFFAALKPPFETESVEAAIPEELKEKIQGRGIVHGEWVQQQLFLQHPSVGCFVSHCGWASLSEALVNDCQIVLLPQVGDQIINARIMSVSLKVGVEVEKGEEDGVFSRESVCKAVKAVMDEKSEIGREVRGNHDKLRGFLMNADLDSKYMDSFNQKLQDLLG

SEQ ID NO: 57 - DNA, 1380 bp, Artificial Sequence
  Codon optimized I. purpurea IP3GGT nucleotide sequence
atgggttctcaagctacaacttaccatatggccatgtatccatggtttggggttggacatttgactggtttcttccgtttggcaaacaaattagctggcaaaggacatagaatctcatttctaattcctaaaaacactcaatctaagttagaatctttcaaccttcatccacacttaatctcttttgtgcctatcgttgtcccaagtataccaggcctgccacctggtgcagagactacatcagatgttcctttcccaagtacacatttgctaatggaagcaatggacaagactcaaaacgatatagagattatcctgaaggatcttaaagtagatgttgttttctatgattttactcactggttgccttctctggccagaaagattggcattaagagtgtcttttactccaccatttctcctttaatgcatggatatgctttatcaccagaaagacgtgtagttggtaagcaattgacagaggcagatatgatgaaggccccagcttctttcccagacccatccattaagctacatgcacatgaagctaggggttttacagccagaaccgttatgaaattcggtggtgacatcacctttttcgatagaatattcacagcagtttccgaaagtgatggcctggcctactctacttgtagagagatcgagggacaattctgtgattacattgaaacacaattccagaagccagtcttgttagccggtccagctttgccagtcccatccaaatccactatggaacaaaagtggtcagattggttggggaaattcaaggaaggctccgtcatctactgtgctttcgggtctgaatgtacattgagaaaggacaaatttcaggaacttttatggggtttggaattgacaggaatgcctttcttcgctgctctgaagccaccttttgagactgagtctgttgaggctgctatccctgaggaactaaaggaaaagattcagggaagaggtatagtacatggagaatgggtacaacaacaattgtttcttcaacacccatctgtcgggtgcttcgtttctcactgcggctgggcaagtttatctgaagcccttgttaatgattgtcaaatcgtgttacttccacaagttggcgatcagattatcaacgccagaataatgtcagtatcacttaaagtgggcgtggaagttgaaaagggtgaggaggacggtgtcttttcaagagaatctgtgtgcaaggctgttaaagcagtaatggatgaaaaatctgaaatcggtagagaagtcagaggtaatcatgataaactgaggggtttcttgatgaatgcagacttagattcaaagtacatggattcattcaatcaaaagctacaagatttgctaggttaa

SEQ ID NO: 58 - protein, 438 aa, Bellis perennis
MDSKIDSKTFRVVMLPWLAYSHISSFLVFAKRLTNHNFHIYICSSQTNMQYLKNNLTSQYSKSIQLIELNLPSSSELPLQYHTTHGLPPHLTKTLSDDYQKSGPDFETILIKLNPHLVIYDFNQLWAPEVASTLHIPSIQLLSGCVALYALDAHLYTKPLDENLAKFPFPEIYPKNRDIPKGGSKYIERFVDCMRRSCEIILVRSTMELEGKYIDYLSKTLGKKVLPVGPLVQEASLLQDDHIWIMKWLDKKEESSVVFVCFGSEYILSDNEIEDIAYGLELSQVSFVWAIRAKTSALNGFIDRVGDKGLVIDKWVPQANILSHSSTGGFISHCGWSSTMESIRYGVPIIAMPMQFDQPYNARLMETVGAGIEVGRDGEGRLKREEIAAVVRKVVVEDSGESIREKAKELGEIMKKNMEAEVDGIVIENLVKLCEMNN

SEQ ID NO: 59 - DNA, 1317 bp, Artificial Sequence
  Codon-optimized Bellis perennis UGT94B1 nucleotide sequence
atggattctaaaatcgattcaaagacattcagagtcgttatgttgccttggcttgcatactcacacatttcatcattcctagtgtttgccaagagactaacaaatcataacttccacatctacatttgttcctctcaaacaaatatgcaatacctgaaaaacaacttgacgtctcagtattcaaaatctatacaactgattgagttgaatcttccatctagttccgaattgcctctgcagtatcatactactcacggactaccaccacaccttacgaaaacattgtctgatgattatcaaaagtccggacctgactttgaaaccattttgatcaaattgaacccacatctggtaatctacgactttaatcaactttgggctccagaggttgctagtacacttcatattccatccatacagttactgtctggttgcgtcgccttatatgccttagacgcccatctgtacacaaagccactagacgaaaacttggctaagtttcctttcccagaaatctatcctaaaaacagagatattcctaagggaggtagtaaatacatcgaaaggttcgtagactgtatgagaagatcttgtgaaatcatattagtcagaagtaccatggaacttgaaggaaaatacattgattacttgtctaagacattagggaaaaaggtgttgccagtagggcctctggtgcaagaggcttctttgttgcaagatgatcatatatggattatgaagtggttagacaaaaaggaggagtcatccgtcgtgtttgtttgttttggttctgagtacatcttatcagacaacgaaatagaagatattgcttatggcctagagttgtcccaagtaagtttcgtttgggcaataagagctaagacttctgccttaaatggcttcattgatagagtgggtgataaaggcttagtcatcgataaatgggttccacaggctaacatcttatctcactcttctactggtggattcattagtcattgcggttggtcatcaacaatggaatctattagatatggggttcctattatcgccatgccaatgcaattcgatcaaccttacaatgctaggttgatggaaactgttggtgcaggtatcgaagttggcagagatggcgaaggtagattgaaaagagaagagattgctgccgtggttagaaaggtcgttgttgaagattctggggaatccataagggagaaggcaaaggaattgggagaaatcatgaaaaaaaacatggaggccgaagtagatggtatagtgattgaaaatctagttaagctatgtgagatgaacaattaa

SEQ ID NO: 60 - protein, 440 aa, Leishmania infantum
MHSTRHILRQRAVLVTGARTPFVKSFGALMKADTLELASASVAGLLNKTSLDPRDIDHIVWGNVVLQGSAHNCAREIVIDLNMPKKIIGNLTSMACASGLSSLSQACMLIEGGHADVVIAGGSDSVSNTEVPLPRSVTYGLMMAQRKGVMGFFKEAGYNPFKWFPGGIALTERSTGKTMGWHGDLIAELNSISRDDQEALAVASHANAARAEKAGYFKEEIVPVTIDKKGKKTEVTCDDVMQRDTEKMKAKMPSLKPVFRKEGGTITAATSSTLTDGGSAMLVMSEEKAKKLGYPTDVCVKSWYFSGIDPYPQLLLAPVLGWGPALKKAGLTPKDIDLYEIHEAFAAQVLATIKCLKSQEFFDRYANGAKPVLTEDIDLSKLNVNGGSLALGHPFAATGGRIVISLANELRRSGKRHGLVSICAAGGLGGVAILEHTASK

SEQ ID NO: 61 - DNA, 1323 bp, Leishmania infantum
atgcactcgactcgccatattttgcgtcaacgagcggtcctcgtcaccggggcgaggacgccgtttgtcaagtcctttggggctctgatgaaggcagacacgctggagctggcgagtgcatccgtagccggtctcctcaacaagacgtcgctggatcccagagacattgaccacattgtgtggggcaacgtggtgcttcaaggaagcgctcacaactgcgcgcgcgagatagtgattgatctgaacatgccgaagaagatcatcggcaatctcacaagcatggcatgcgcgagtggacttagctcgctctcgcaggcatgcatgctgatcgagggtgggcatgctgatgtcgttattgccggtgggagcgacagtgtgagcaatacagaggtcccactgccacgctccgtgacgtacgggctgatgatggcccagaggaagggcgtcatgggcttcttcaaggaagcgggctacaatccgttcaagtggtttccgggcggcattgcgctgacagagcggagcactggaaagaccatggggtggcacggggatctcattgcggagctcaacagcatctcgcgcgacgaccaggaggctctggcggtggcttcgcacgctaatgccgcccgggctgaaaaggcggggtacttcaaagaggaaattgtccctgtcacgattgataagaaaggtaagaagaccgaggtgacctgcgacgacgttatgcagcgcgacactgagaaaatgaaagccaaaatgccaagcctcaagcccgtttttcgaaaggagggaggaaccatcacggctgccacgtcaagcaccttgacagatggaggtagcgcgatgctcgtcatgtctgaggagaaggcgaagaagcttggatacccgaccgatgtttgtgtcaagagctggtacttctccggaattgatccttatccgcagctccttctcgcacctgttctgggctggggcccagcgctgaagaaggcgggcctgacgccgaaggacatcgatctctacgagatccacgaagcctttgcggctcaggtgctcgcgacgatcaagtgcctgaagtcgcaggagttctttgaccggtacgctaacggcgccaaacctgttctaacggaagacatcgacttgtcgaagctgaacgtgaatggcgggtccctggcactgggtcacccgttcgctgcaactggtggtcggattgtgacctcgcttgccaatgagctgcgacggtccggcaagcgccatggccttgtgagcatttgcgctgctggcggtctcggcggcgttgctattctagagcacactgccagtaagtag

SEQ ID NO: 62 - protein, 527 aa, Artificial Sequence
  truncated Saccharomyces cerevisiae HMG
MAADQLVKTEVTKKSFTAPVQKASTPVLTNKTVISGSKVKSLSSAQSSSSGPSSSSEEDDSRDIESLDKKIRPLEELEALLSSGNTKQLKNKEVAALVIHGKLPLYALEKKLGDTTRAVAVRRKALSILAEAPVLASDRLPYKNYDYDRVFGACCENVIGYMPLPVGVIGPLVIDGTSYHIPMATTEGCLVASAMRGCKAINAGGGATTVLTKDGMTRGPVVRFPTLKRSGACKIWLDSEEGQNAIKKAFNSTSRFARLQHIQTCLAGDLLFMRFRTTTGDAMGMNMISKGVEYSLKQMVEEYGWEDMEVVSVSGNYCTDKKPAAINWIEGRGKSVVAEATIPGDVVRKVLKSDVSALVELNIAKNLVGSAMAGSVGGFNAHAANLVTAVFLALGQDPAQNVESSNCITLMKEVDGDLRISVSMPSIEVGTIGGGTVLEPQGAMLDLLGVRGPHATAPGTNARQLARIVACAVLAGELSLCAALAAGHLVQSHMTHNRKPAEPTKPNNLDATDINRLKDGSVTCIKS

SEQ ID NO: 63 - DNA, 1584 bp, Artificial Sequence
  Synthetic nucleotide sequence encoding truncated Saccharomyces cerevisiae HMG
atggcagctgaccaattggtgaaaactgaagtcaccaagaagtcttttactgctcctgtacaaaaggcttctacaccagttttaaccaataaaacagtcatttctggatcgaaagtcaaaagtttatcatctgcgcaatcgagctcatcaggaccttcatcatctagtgaggaagatgattcccgcgatattgaaagcttggataagaaaatacgtcctttagaagaattagaagcattattaagtagtggaaatacaaaacaattgaagaacaaagaggtcgctgccttggttattcacggtaagttacctttgtacgctttggagaaaaaattaggtgatactacgagagcggttgcggtacgtaggaaggctctttcaattttggcagaagctcctgtattagcatctgatcgtttaccatataaaaattatgactacgaccgcgtatttggcgcttgttgtgaaaatgttataggttacatgcctttgcccgttggtgttataggccccttggttatcgatggtacatcttatcatataccaatggcaactacagagggttgtttggtagcttctgccatgcgtggctgtaaggcaatcaatgctggcggtggtgcaacaactgttttaactaaggatggtatgacaagaggcccagtagtccgtttcccaactttgaaaagatctggtgcctgtaagatatggttagactcagaagagggacaaaacgcaattaaaaaagcttttaactctacatcaagatttgcacgtctgcaacatattcaaacttgtctagcaggagatttactcttcatgagatttagaacaactactggtgacgcaatgggtatgaatatgatttctaaaggtgtcgaatactcattaaagcaaatggtagaagagtatggctgggaagatatggaggttgtctccgtttctggtaactactgtaccgacaaaaaaccagctgccatcaactggatcgaaggtcgtggtaagagtgtcgtcgcagaagctactattcctggtgatgttgtcagaaaagtgttaaaaagtgatgtttccgcattggttgagttgaacattgctaagaatttggttggatctgcaatggctgggtctgttggtggatttaacgcacatgcagctaatttagtgacagctgttttcttggcattaggacaagatcctgcacaaaatgttgaaagttccaactgtataacattgatgaaagaagtggacggtgatttgagaatttccgtatccatgccatccatcgaagtaggtaccatcggtggtggtactgttctagaaccacaaggtgccatgttggacttattaggtgtaagaggcccgcatgctaccgctcctggtaccaacgcacgtcaattagcaagaatagttgcctgtgccgtcttggcaggtgaattatccttatgtgctgccctagcagccggccatttggttcaaagtcatatgacccacaacaggaaacctgctgaaccaacaaaacctaacaatttggacgccactgatataaatcgtttgaaagatgggtccgtcacctgcattaaatcctaa

SEQ ID NO: 64 - protein, 1226 aa, Ganoderma lucidium
MRAVLRLLSTHTVFSPIETIVSVFVLATLAYFHILSGIKHSSFFASSHPPAIRPAFAHLTNGEWVAVSQHDWTEAWKHPGGSLDALELQQVVFTLDDKTQPSAVLDASAISQHLVSNVPALSGKAYSSLCHHPNVSGTSCFTSVSGPGASPILTLSFKPGTRDDWLGSLRKEKTITLDGVKYDVGAGKRQESIGDMESSKWVAYALSALVLRFWELTKADSLDILVVLTGYILMHVTFMRLFLASRALGSNFWLSAGIFSSATISFLFTLPMCRSMDIPLDPIALTEALPFLVCTVGFDKPLRLARAVMAHPNILKPQDDGRMKAAGDVILEALDRVGNMILRDYALEIAVLFVGVNSRVGGLKEFCAVAAALLAMDRLMTFTLYTAVLTIMVEVRRIKKVRDMTKARSRSSSITAVTANGTAIRGVLSRKSSKQSVTEPETTKNLRQRATDSAIGVKGSLLKDGGRLQEAEENPMARLKLLLIASFLTLHILNFCTTLTSATANARHQRHPFRTVQEVVPIPRVDITTPAIANILSHLAVAQEPMFTVVGSEPIELLVKVAAPVYVHALPLAPALRASNTNTGEAIENFMSSWSSLVGDPVVSKWIVALLAVSVALNGYLLKGIAAGSGLAAMRAVRSQGVRFRSRARSIVKISDEPEPEPEHSIDPAPVVFFASAAPAVEAPAPAPAPEPEPPVNRPPPLTIFSRPLNLETVDKKLQDALPIRSPPPVEPITPESREVEPTQVEVRSLAECVDVFENGPRPVSVALKTLNDEEVILLCQTGKIAPYALVKMLADFDRAVRVRRALISRASRTKTLENSLVPMKDYDYARVMGACCENVIGYMPLPLGIAGPLKIDGLMYPIPMATAEGTLVASTSRGCKALNAGGGVTTVLTADGMTRGPAIDFPSIVRAAEAKAFIESEDGYATIREAFESTSRFAKLQKIKCALAGRTLFVRFATRTGDAMGMNMISKATEKALDVLSHEFPEMVVLALSGNYCTDKKPAAISWIEGRGKSIVAEAVIPGKVVKSVLKTTVESLCNVNTKKNLIGSAMAGSVGGFNAHAANILTAVFLATGQDPAQNVESSNCMTLMEPTNGGEDLLMTISMPCIEVGTVGGGTILEPQGAVLDLLGVRGAHPTNPGQNAQQLARIIASAVMAGELSLISALAAGHLVRAHLAHNRSQLNTPMPSRPHTPGPEDVSHVQQLPTPSASDDKGVTAQGYVVEAK

SEQ ID NO: 65 - DNA, 3681 bp, Ganoderma lucidium
atgcgtgcggttctgcgcctgctgtccacacacacagtcttctcccccatcgagaccattgtctccgtcttcgtccttgcaaccctcgcatacttccatatcctctcgggcatcaagcactcctctttctttgcctcctcacaccctcctgccatccgcccggcgttcgcccatctcaccaacggagaatgggttgcggtctcacagcacgattggacagaagcctggaagcatcctggtggtagcctcgacgcgttggagttgcagcaggtggtcttcacgcttgacgacaagacgcagccgagtgccgtgcttgacgcgtctgccatctcacaacacctggtgtcaaacgttcctgcgctttccggcaaagcctactcatccctttgccaccatcctaacgtatccggaacgtcgtgtttcaccagtgtctctggccccggagcatctcccatcctcactctttccttcaagcctggaactcgggacgattggcttggttcgctccggaaggagaagacgatcacgcttgatggtgtcaagtacgacgttggtgcagggaaacgccaggagagcatcggagacatggagagtagcaagtgggttgcttacgctctcagtgcgctcgtcttgcgtttctgggagctcaccaaggcggactcgcttgatatcctcgtcgtcctgacaggatatattctcatgcatgtgacgttcatgaggctattcctggcttctcgggcactgggttccaacttctggctctccgccggcatattctcctcggcaactatttccttcctcttcactctacccatgtgcagatccatggacattcccctcgatcccatcgcccttacggaggccctacccttcctggtttgcactgtcggattcgacaagccgctccgtctcgcacgtgccgtcatggcccatcccaacatccttaagccacaggacgatgggcggatgaaggcggctggcgacgtcattcttgaggcgctcgatcgcgtcggtaacatgatccttcgcgactacgctttggagatcgctgtgctctttgtcggtgtcaacagccgcgtcggtggcctcaaggagttctgcgccgttgccgctgcgctgctcgctatggaccgtttaatgactttcacgctttacactgcggttctgacgatcatggtggaggttcgtcgtatcaagaaggtccgggacatgacgaaggcccgttcccggtccagttccatcacagcggttacggctaatgggacggctattcgcggagtcttgtctcgcaagagcagcaagcagagcgtgactgagccggagacgacgaagaacttgcgccagcgggcaaccgactcagctattggcgtcaaaggttcgttactgaaggacggtggcaggttgcaggaagccgaggagaacccgatggcgaggctcaagctgcttttgatcgcctctttcctcacgctacacatcctgaacttctgcacgaccctcacttctgccaccgccaacgctcgtcaccaaagacatccctttcgcacagttcaggaggttgttcctatcccgcgtgtcgacatcactaccccggccattgcgaacatcctttctcatctcgcagtggcacaggagcccatgttcaccgtggtgggctcggagcccatcgaacttttggtcaaggtcgccgcgcccgtctacgtccacgctctccctcttgccccggccctccgtgcttctaacaccaacaccggggaggccatcgagaacttcatgtcgtcctggagctcgctcgtcggcgaccccgttgtctcgaagtggattgtcgccctcctcgcagtcagcgtggcactgaacggttacctgctcaagggtatcgctgctggttctggtctcgcggccatgcgtgcggtccgcagccaaggcgttcgtttccgttcgcgcgcccgctccatcgtcaagatctccgacgagccggaaccggaaccggaacactcgattgatcccgctcccgtcgtgttcttcgccagtgctgccccagctgtggaggctcccgcacccgcccctgctcccgaacccgagcctcccgtgaaccgtccccctcccttgactatcttcagccgtccgttgaacttggagaccgtcgacaagaagctccaggatgcccttcccatccggtcgccgcctcccgtggagcctattacccccgaatcgcgcgaagtcgagcctacccaggttgaggtgcggtctcttgccgaatgtgtcgatgtcttcgagaacggtccgcgccccgtatcggttgcgctcaagaccttgaacgacgaagaggtcatcctcctatgccaaactggaaagatcgccccgtacgccctcgtgaagatgcttgctgacttcgaccgcgctgtgcgggtccgtcgtgccctcatttcccgtgcttcgcgaaccaagaccctcgagaactcgctcgtcccgatgaaggactacgactacgcccgtgtgatgggcgcgtgctgcgagaacgtcattggctacatgcctctgcccctcggtatcgccggcccgctcaagatcgacggcctcatgtaccccatcccgatggccaccgctgaaggcacgctcgtcgcgtcaacatctcggggctgcaaggctctcaacgccggcggaggtgttaccacggtcctcaccgctgacggcatgacgcgcggccccgcgatcgacttcccgtccattgtgcgcgcggcggaggcgaaggcgttcatcgagtccgaggacggctacgcgacgattagggaggcgttcgagtcgacatcgcggttcgcgaagctgcagaagatcaagtgcgcgctcgcggggcggacgctgttcgtgcggttcgccacgcggacaggggacgcgatgggcatgaacatgatctcgaaggcgacggagaaggcgctcgatgtgctcagccacgagttcccggagatggtcgtgctcgcgctgtcgggcaactactgcacggacaagaagcctgccgcgatcagctggatcgagggccgcgggaagagtatcgtcgcggaggcggtcatccccgggaaggtcgtcaagagtgtgctcaagacgacagtcgagagcctgtgcaacgtgaacacgaagaagaacttgatcgggagtgcgatggcgggctcggtcggcggattcaacgcgcatgcggcgaacatcctcaccgcggtcttccttgcgactggccaggatcctgcacagaacgtggagagctcgaactgcatgaccctcatggagccaacaaatggcggtgaggacctactcatgaccatctccatgccctgcatcgaggtcggcactgtcggcggcggcaccatcctcgagccccagggcgctgtcctcgacctgcttggcgtccgcggcgcgcaccctacgaaccctggacagaacgcgcagcagctcgcgcgcatcatcgcgtcagcggtcatggcgggcgagctctcgctcatctctgcactcgccgctggccacctcgtacgtgcgcaccttgcgcacaaccgctcgcagctcaacacgccgatgccgtcgcggccacatacgccaggccccgaggatgtctcgcacgtgcagcagctgccgacaccaagtgcgagcgacgacaagggcgtcaccgcgcaggggtacgtcgtcgaggcgaagtga

SEQ ID NO: 66 - protein, 888 aa, Bos taurus
MLSRLFRMHGLFVASHPWEVIVGTVTLTICMMSMNMFTGNNKICGWNYECPKLEEDVLSSDIIILTITRCIAILYIYFQFQNLRQLGSKYILGIAGLFTIFSSFVFSTVVIHFLDKELTGLNEALPFFLLLVDLSRASALAKFALSSNSQDEVRENIARGMAILGPTFTLDALVECLVIGVGTMSGVRQLEIMCCFGCMSVLANYFVFMTFFPACVSLVLELSRESREGRPIWQLSHFARVLEEEENKPNPVTQRVKMIMSLGLVLVHAHSRWIADPSPQNSTADNSKVSLGLDENVSKRIEPSVSLWQFYLSKMISMDIEQVITLSLALLLAVKYIFFEQAETESTLSLKNPITSPVVTQKKITDDCCRRDPVLVRNDQKFHAMEEETRKNRERKVEVIKPLLAENDTSHRATFVVGNSSLLGTSLELETQEPEMELPVEPRPNEECLQILENAEKGAKFLSDAEIIQLVNAKHIPAYKLETLMETHERGVSIRRQLLSKKLPEPSSLQYLPYRDYNYSLVMGACCENVIGYMPIPVGVAGPLCLDGKEFQVPMATTEGCLVASTNRGCRAIGLGGGASSRVLADGMTRGPVVRFPRACDSAEVKAWLETPEGFTVIKEAFDSTSRVARLQKLHMSVAGRNLYIRFQSRSGDAMGMNMISKGTEKALSKLQEYFPEMQILAVSGNYCTDKKPAAINWIEGRGKSVVCEAVIPAKVVREVLKTTTEAMIEVNINKNLVGSAMAGSIGGYNAHAANIVTAIYIACGQDAAQNVGSSNCITLMEASGPTNEDLYISCTMPSIEIGTVGGGTNLLPQQACLQMLGVQGACRDNPGENARQLARIVCGTVMAGELSLMAALAAGHLVRSHMIHNRSKINLQDLQGTCTKKAA

SEQ ID NO: 67 - DNA, 4618 bp, Bos taurus
ccgcgtctccgttgactggagacgggtggagcgccggctcccgggaactgtggcctctagtgagatccggaggatccgaggactctgcagctgcaatgctgtcaagacttttccgaatgcatggcctcttcgtggcctcccatccctgggaagtcatagtggggacagtgacgctgaccatctgcatgatgtccatgaacatgtttactggcaacaataagatctgcggttggaattatgaatgtccgaagttggaagaggatgttttgagcagcgacatcataattctgacaataacacgatgcatagcaatattgtatatttacttccagttccagaatttacgccaacttggatcaaaatatattttgggtattgctggactcttcacaattttctccagtttcgtattcagtacagttgtcattcatttcttagataaagaattgacaggtttgaatgaagctttgccctttttcctgctgctggtcgacctttctagagcaagtgcgctagccaagttcgccctcagttctaactcacaggatgaagtgagggagaacattgctcgtgggatggcgattttaggtcccaccttcaccctggatgctcttgtagaatgtcttgtgattggagttggtaccatgtcaggggtgcgtcagctcgaaatcatgtgctgctttggctgcatgtcggttctcgccaactactttgtgttcatgactttcttcccagcttgtgtgtccttggttctggagctttctcgggaaagccgcgagggccgtccaatctggcagctcagccattttgcccgagtcttagaagaagaagaaaataagccaaatcctgttactcagagggttaagatgattatgtctctaggcttggttcttgttcacgctcacagtcgctggatagctgatccttctcctcaaaacagcacagcagacaattctaaggtctctttaggactggatgaaaatgtgtccaagagaattgaaccgagtgtttccctctggcaattttatctctctaaaatgatcagcatggatattgaacaagttattaccctaagtttagctctccttctggctgtcaagtacatcttctttgaacaagcagagacagaatctacactctcgttaaaaaatcctatcacatctcctgtagtgacccaaaagaaaatcacagacgattgttgtagacgtgaccctgtactggtcagaaatgaccagaaattccatgcaatggaggaggagaccaggaaaaacagagaaagaaaagttgaggttataaaacccttactggcagaaaatgacacctcacacagagccacattcgtggtggggaactcctccttactcggtacttcgctggaactagagacacaggagcctgaaatggaactccctgtggagcctcggcctaatgaagagtgtctgcagattcttgagaatgcagagaaaggtgcaaaattccttagtgatgctgagatcatccagttggtcaatgcaaagcatatcccagcttacaaattggaaactctgatggaaacccatgagcgaggtgtatctattcgccgacagctactttccaaaaaacttccagagccttcttctctccagtatctaccttacagggactataattactccttggtgatgggagcttgctgtgagaacgttattggatatatgcccatccctgttggagtggcaggacctctgtgcttggatggaaaagaatttcaggttccaatggcaacaacagaaggctgtcttgtggccagcactaatagaggctgcagagcaataggccttggtggaggtgccagcagccgagtccttgcagacgggatgactcgtggcccagtggtgcgttttccccgtgcttgtgactctgcagaagtgaaggcctggcttgagacgcctgaagggttcacagtgataaaggaagccttcgacagcaccagcagggttgcacgtctacagaaactgcatatgagtgtggccggacgcaacctttacatccgttttcagtccaggtcaggtgatgccatggggatgaacatgatttcaaagggtacagagaaagcactgtccaaacttcaggagtatttccccgaaatgcagattttggccgtcagtgggaactattgtacagacaagaaacctgcggccatcaactggatagagggacgaggaaagtctgtggtctgtgaagctgtcattccagccaaggttgtcagagaagtattaaagactacaacagaggctatgattgaggtcaacattaataaaaacctggtgggctctgccatggctgggagcatcggcggctacaacgcccacgcagcgaacattgtaactgccatctacattgcctgtggacaggatgcagcacagaatgttggtagttcgaactgtattactttaatggaagcaagcggtcccacgaacgaagacctgtacatcagctgcaccatgccatctatagaaataggaaccgtgggcgggggcaccaacttgctgcctcagcaggcctgcctgcagatgctaggcgtccaaggagcatgcagagacaaccccggggaaaatgcgcggcagctggcccgaatcgtgtgcggcacggtgatggctggggagctgtctctgatggcagcactggcagcaggccatctggtcagaagtcacatgattcacaacaggtcaaagataaatttgcaagacctccaaggaacttgcactaagaaggcagcttgaacagcctgaccattcagaactaaaaaatgggcattgggttctaaaggactaacgtaaaatctgtgaattaaaaaactcaatgcaatgtcgtgttgagaatgagtagacatgatcagtgagacgactgcttggtttctggctctttcagaatgattgaggttcttctttccatgcagagttctcagatctgaaaacagtttacatgctttacatgctgtgtcctctgcaagatctcgacatggatattatgcctttatagcatcacagatggtaatctacagcacacttctgaaggagaatacagctggaaaaaaaactgttttcttttcatggaactcatggagatcagtgtgagattgaaccctcctcctgtccacacccacccggccccaaccctgggttgaaaatggatttttaaattatattgtagctgacaaaactcctgatttcatagttaatttattaagtctgggttgtagacctttaagaaataggagctaagtttattttttgtaaactaatacttcatttggtgctggtctattttgatttcggggaatagccaacataattcttcagaaagggacctgctttcttaaaaggaagaattactcttattcccagattacagaattatgtgctaagcagtgctaaacagttttctttcaagaaaacaaatcactgcatttatttttgcaggctatttgttcagagacgacttgtctaaatataaatgtttgtctagattgattataacggatctttcagtatataaggctttaagaagcagagttttgtgctctttattaaagatacaagagctcttaatattgcttagacaaaggtgactatttatcaatgaaatacaagtctgtgacctctctcagaactcagagggtggaaaaggacaggtttgggagaaatttaccatttcttgaagccaacttaaatttcttaagagacaaatttatttagctgaaaaatctaggtagtttttgtaaagaactgtaccagatctgtatatgttgtaataaagtttcttgtgctaggagtttattgaaagtgttcaagaaataaataaaatcaactgatattctggtaaaatactctcagcttgggccagagcagacagtattctttaatgttgtccaggaaaccctggcttgcttgttgagcctaatgaaggggagagtcctctttcagagccagtgaaggcaccgcatgaatggccttggagggagtgtcccttgtcctgtggccaggaggttggtggctgaaaggttcacacagggctatttgatggacccaaaaaagcttcctcagggggtcagcagagttgttgaatcttaattttttttaatgtaacttttgtataaataataaagaactccttattttgtattacatcaaatgcttcaagtgttggtcctggaaggctggaggctcatgcagaagatggactttgagaaccattccagtcatgccatggcagcatggagagcctgaatggtggtgtctgctttattgctggggaagactgacattttctgttgttatataaaagtttaaattgtttctgttgtgacttttcatccagtgacttcttatttatctgaattttttatggaagtggcagtgaaaaatattttgggtcctcattttggtgactgtaacacatatcatcttgctaaactgatgttttgtacaattactaaactgtatacattttgttatacttttttccccccagttccagtaaattatgaaaaggaagttaatactaaaaaaaaaaaaaaaaaaaaaaaaaaaaaaaaaaaaaaaaaaaaaaaaaaaaaaaaaaaaaaaaaaaaaaaaaa

SEQ ID NO: 68 - protein, 567 aa, Artemisia annua
MDLRRKLPPKPPSSTTTKQPSHRSHSPTPIPKASDALPLPLYLTNTFFFTLFFSVAYYLLHRWRDKIRSGTPLHVVTLTELSAIVLLIASFIYLLGFFGIDFVQSFTSRENEQLNNDDHNVVSTNNVLSDRRLVYDYGFDVTGDNDNDNDDDVIVKSVVSGEVNSYSLEASLGDCYRAAKIRKRAVERIVGREVLGLGFEGFDYESILGQCCEMPIGYVQVPVGVAGPLLLNGGEFMVPMATTEGCLVASTNRGCKAICLSGGATAILLKDGMTRAPVVRFATAERASQLKFYLEDGVNFDTLSVVFNKSSRFARLQNIQCSIAGKNLYIRFTCSTGDAMGMNMVSKGVQNVLDFLQNDFPDMDVIGISWKFCSDKKPTAVNWIEGRGKSVVFQAVITKKVVRKSALNPQTCTCRTLTCLRPLLVLLLLVLLVDLMHMLHIVSAVFIATGQDPAQNIESSHCITMMEAVNNGKDLHVNVTMPSIEVGTVGGGTQLASQSACLNLLGVKGACIESPGSNAQLLARIVAGSVLAGELSLMSAISAGQLVKSHMKYNRSSRDMSAIASKV

SEQ ID NO: 69 - DNA, 1704 bp, Artemisia annua
atggatttgagaaggaaattaccacctaagcctccatcttcaacaacaacaaaacagccaagtcataggtcccattctcctacgccaattccaaaggcttcagatgcattgcctcttccattgtacctgaccaatacgtttttcttcactcttttcttttccgtagcatattacctgttgcataggtggagagacaagattagatccggaacacctttacacgttgtgacactgactgaactatccgcaattgtactgctgattgcttccttcatctatcttttaggctttttcggtattgattttgtgcaatctttcacatcaagagaaaatgagcaactaaacaacgatgatcacaacgtcgtgtcaacaaacaatgttttatctgatagaaggttagtttacgactatggattcgatgtgacaggagacaacgataacgataatgatgacgatgttattgtgaaaagtgtcgtttctggggaagttaattcttatagtttggaggcttccctaggagattgttacagagccgcaaagattagaaagagagccgtcgagagaattgtcgggagagaagtattaggcttgggtttcgagggatttgattatgaatctatcctggggcaatgttgtgaaatgcctatcgggtacgtccaagtgccagtaggtgtcgctggacctttattgttaaatggtggggaattcatggttccaatggctacaactgaaggctgtcttgtagcttccactaatagaggttgtaaagccatatgcttatcaggtggtgccactgccatattgctaaaagatggtatgacaagagccccagtagtgagattcgccacagctgagagagcttcacaactaaagttttacttggaagatggtgtcaatttcgatacattgtctgttgtctttaacaaaagttcaagatttgccagattgcaaaacatccaatgctcaattgccggtaaaaacttgtacattaggtttacttgctccacaggcgacgccatgggtatgaacatggtttcaaaaggagtacaaaatgtattagactttttacaaaatgattttcctgatatggacgtaattgggatctcttggaagttctgctctgacaaaaagccaacagctgtcaactggattgagggcagaggaaagtctgtcgttttccaggccgtaattaccaaaaaggtggttagaaagtctgcactgaaccctcaaacttgcacatgtagaactttgacctgtttaagaccattattggttctgctacttctggttttgctagtggacttaatgcatatgcttcatatcgtgtctgccgtgttcatcgctaccggtcaagatccagctcagaatatcgaatctagtcactgtatcactatgatggaggctgtcaacaatggtaaggatttgcacgttaatgttacgatgccatctatagaagttggcacggtgggaggtggcactcagctagcctctcaatcagcctgtttgaacttgcttggtgtaaagggtgcctgtatagaatccccaggatcaaacgcccagttgttagctagaatcgttgctggttctgttctggcaggcgaattaagtttgatgtcagctataagtgctgggcaactagttaaatctcatatgaaatacaataggtctagtagagatatgtcagcaatagcttctaaggtctaa

SEQ ID NO: 70 - protein, 435 aa, Trypanosoma cruzi
MFRRAILLGCSAAKTPWSECSNAQLVDAVKSRKISFYGLEQALEPDYRRAIEVRREVVSEIASQQPEAKKKQSALHTIPFENYDWNKVVGQNCENIIGYVPIPLGVAGPILIDGKEYPIPMATTEGALVASTHRGARAITRSGGCKTLLLGEGMTRAPVVELPSLEEAGRLHKYCNENFLSLKEAFESTTQYGKLNSLKCVLAGRKAYLRFRATTGDAMGMNMITKGVDKALSVLQQHFPSMEILALSGNYCTDKKPSAVNWIDGRGKSVVAEATLLADVVEDTLKCTVDSLVSLNIDKNLVGSAMAGSVGGFNAQAANAVAAIFIATGQDPAQVVESSMCITTMSKVGNDLLISVTMPSIEVGVVGGGTGLAAQRGCLELIGCGGPSKESPGTNAQLLSRVVAAGVLSAELSLMSGLAAGHLLSAHMRLNRKKK

SEQ ID NO: 71 - DNA, 1308 bp, Trypanosoma cruzi
atgtttagaagagctatactgttaggatgctctgctgccaagacaccatggtctgagtgttctaacgctcaattagttgatgcagttaagtctagaaagatctcattctacggtcttgaacaagccttggaaccagattatagaagggctatcgaagtaaggagagaggttgtctctgaaatcgcctcacaacagccagaagcaaaaaagaagcaatccgcattgcacacaataccatttgagaattatgattggaataaggtcgttggccaaaactgtgaaaacattattggatacgtcccaataccactgggcgttgctggccctattttgattgatggtaaagagtacccaataccaatggctacaacagaaggcgctttggtcgctagtactcatagaggtgctagagctattacaagatccggaggttgtaagacattgttattaggtgaaggtatgacaagagcaccagtggttgaattgccttcattagaggaagctgggcgtttgcacaagtactgtaatgagaacttcttatctttaaaggaagcatttgaatcaactacccaatatggaaaacttaattctttaaagtgcgtactagctggtagaaaagcataccttagattcagagccactacaggcgatgctatgggcatgaacatgataacaaagggtgtagacaaagcactgtctgttctacagcaacatttcccttcaatggaaatcctagccctaagtggtaattactgtaccgacaaaaagccatctgctgtaaattggattgatggcagaggtaaatcagtggttgcagaagccactttattggctgatgttgtcgaagatactctgaaatgtacagtcgattctttggtatccttgaatatcgacaaaaaccttgttgggtcagctatggctggttctgttggaggttttaacgcccaggctgcaaacgctgtggcagccattttcattgcaaccggtcaagatcctgctcaagtggtagaaagttcaatgtgtatcactacaatgtccaaggtaggtaacgatctattgatctctgtgaccatgccttctatcgaggtcggggtcgtgggaggagggactggtcttgctgcccaaagaggatgcttagagttaatagggtgcggaggcccatctaaggagtctcctggtactaatgcccaacttctaagtagagttgttgcagctggcgttttatcagccgaactttccttgatgtccggactggcagcaggtcatctattgtcagcacatatgagattgaacagaaagaagaaataa

SEQ ID NO: 72 - protein, 426 aa, Staphylococcus aureus
MQSLDKNFRHLSRQQKLQQLVDKQWLSEEQFNILLNHPLIDEEVANSLIENVIAQGALPVGLLPNIIVDDKAYVVPMMVEEPSVVAAASYGAKLVNQTGGFKTVSSERIMIGQIVFDGVDDTEKLSADIKALEKQIHQIADEAYPSIKARGGGYQRIAIDTFPEQQLLSLKVFVDTKDAMGANMLNTILEAITAFLKNEFPQSDILMSILSNHATASVVKVQGEIDVKDLARGERTGEEVAKRMERASVLAQVDIHRAATHNKGVMNGIHAVVLATGNDTRGAEASAHAYASKDGQYRGIATWRYDQERQRLIGTIEVPMTLAIVGGGTKVLPIAKASLELLNVESAQELGHVVAAVGLAQNFAACRALVSEGIQQGHMSLQYKSLAIVVGAKGDEIAQVAEALKQEPRANTQVAERILQDLRSQQ

SEQ ID NO: 73 - DNA, 1281 bp, Staphylococcus aureus
atgcaatccctggacaaaaactttagacacttatcaagacaacagaagttacaacagctagttgataaacaatggctatcagaggaacaattcaatattctacttaaccacccacttattgatgaagaggtagcaaactcattgatagaaaatgtcatcgcacagggcgcactgcctgttggtttactaccaaatatcatcgttgatgacaaagcatacgtcgtgcctatgatggtggaagagccatctgttgttgccgctgcttcatacggcgctaaattggtgaaccaaacaggtggtttcaaaaccgtgtcctcagaacgtatcatgataggtcaaatagtatttgatggagtcgatgataccgagaaactgtctgcagatatcaaggctcttgaaaaacaaatccatcagattgcagatgaggcttacccttctattaaggccagaggtggaggctatcaaaggatcgccatcgatacattcccagaacaacagttgctttcattgaaggttttcgttgatactaaggatgctatgggcgctaatatgttaaacacaatcctagaagcaatcacagcctttttgaaaaacgaattcccacaatctgatatcttgatgtctatcctttccaaccacgcaacagccagtgttgtcaaggtccagggtgaaatagacgttaaggatttggcaagaggagaacgtactggagaagaggtcgctaagagaatggaaagagcatctgtgttagctcaagtggacattcatagagcagcaacacacaataagggtgttatgaatggcattcatgctgtagtcttggctacaggtaatgatactagaggtgcagaagcctctgctcacgcttacgcttccaaagacggtcaatatagagggatagctacatggagatacgatcaagagagacaaaggttaataggaactatagaagttccaatgactctggccattgttggtggcggtaccaaggtactgcctattgctaaggcctctttagaactgttaaacgtagaaagtgcccaagagttgggacatgttgtcgctgccgttggactagctcaaaacttcgctgcatgtagagctttggtttccgaaggtattcaacaagggcatatgtctttgcaatacaagtctttagccatcgtagtcggggctaagggcgatgaaattgctcaggtagccgaagcactaaagcaagagccaagagcaaacactcaagttgcagagagaattttgcaagatttgagaagtcaacaataa

SEQ ID NO: 74 - protein, 436 aa, Artificial Sequence
  Codon optimized Archaeoglobus fulgidus polypeptide
MQVLRLDRRHYKSGKIRRAMSSRIPGFYKLSVEERLKKVAEFAGLSDEEVKAVLSQGLPLDVADRMIENVIGTFELPLGIATNFLIDGKDYLIPMAIEEPSVVAAASNAARMARESGGFTTDYTGSLMIGQIQVTKLLNPNAAKFEVLRQKDEIIERANECDPMLVNLGGGCKDIEARVIDTIMGKMLIVHLIVDVKDAMGANAVNTMCEKVAPFIERITGGKVYLRIISNLAAYRLARAKAVFDKDVIGGEEVVEGIMLAYAFAAADPFRCATHNKGIMNGISALMIATGNDFRAIEAGAHSYAAIGGYKPLTTYEVDRKGNLVGTIEIPMAVGVIGGATKVNPLAKISLKILGVNTAEELARVAAALGLAQNFAALRALATEGIQRGHMELHARNLAIMAGATGDEVDRVVEIMVRDGKIRLDYAKEVLERLRS

SEQ ID NO: 75 - DNA, 1311 bp, Artificial Sequence
  Codon optimized Archaeoglobus fulgidus nucleotide sequence
atgcaggtcttaagattggataggagacattacaaaagtggcaagattagaagagcaatgagttctagaattcctggtttctacaaattgtcagtcgaggaaagactgaaaaaggttgctgaatttgcagggttatctgatgaggaagtgaaagctgttttgtcacaaggtttacctttggacgtagctgatagaatgatcgaaaatgtgatcggtacatttgaattaccacttggtatagcaaccaatttccttattgatggcaaggattatctaatccctatggctatagaggaaccatcagtagttgcagctgcttctaacgcagctagaatggccagagagtctggcgggtttacaactgattacacagggtccctgatgattggtcaaattcaagtcacaaaactgttgaatccaaatgcagctaagttcgaagttctacgtcaaaaagacgaaatcatagaaagagcaaatgagtgtgatccaatgttggtgaatttgggcggtggatgtaaagatatagaagcaagggtgatcgatacaatcatgggtaagatgctaattgttcatctgatcgttgatgttaaagacgctatgggtgcaaatgctgtcaacactatgtgtgaaaaagttgctcctttcatcgaacgtattactgggggaaaggtctatcttagaatcatttccaacttggctgcatatagacttgctagagcaaaggccgtttttgacaaagacgttattggcggagaggaggttgtagaagggatcatgcttgcatacgccttcgctgccgctgacccatttcgttgcgccacccacaataagggtatcatgaatggcatatcagccttaatgatcgctacaggaaacgactttagagccattgaagcaggagctcattcctatgctgcaataggtggatacaaaccactaactacctacgaagttgatagaaaaggtaatctagtaggcacaattgaaatacctatggcagtaggcgtgattggtggtgcaaccaaagtcaacccactagccaagatctctcttaagatactaggagtgaacactgctgaagagttagccagagtcgcagccgctctaggtttggctcaaaactttgctgccttaagagccttggccacagaaggtatccaaagaggtcacatggaattacatgccaggaacttagcaatcatggctggagctactggagatgaggttgacagagttgtagagattatggtgagagatggcaaaatcagattggactacgctaaggaagtattggagagactgcgttcctaa

SEQ ID NO: 76 - protein, 428 aa, Artificial Sequence
  Codon optimized Pseudomonas mevalonii polypeptide
MSLDSRLPAFRNLSPAARLDHIGQLLGLSHDDVSLLANAGALPMDIANGMIENVIGTFELPYAVASNFQINGRDVLVPLVVEEPSIVAAASYMAKLARANGGFTTSSSAPLMHAQVQIVGIQDPLNARLSLLRRKDEIIELANRKDQLLNSLGGGCRDIEVHTFADTPRGPMLVAHLIVDVRDAMGANTVNTMAEAVAPLMEAITGGQVRLRILSNLADLRLARAQVRITPQQLETAEFSGEAVIEGILDAYAFAAVDPYRAATHNKGIMNGIDPLIVATGNDWRAVEAGAHAYACRSGHYGSLTTWEKDNNGHLVGTLEMPMPVGLVGGATKTHPLAQLSLRILGVKTAQALAEIAVAVGLAQNLGAMRALATEGIQRGHMALHARNIAVVAGARGDEVDWVARQLVEYHDVRADRAVALLKQKRGQ

SEQ ID NO: 77 - DNA, 1287 bp, Artificial Sequence
  Codon optimized Pseudomonas mevalonii nucleotide sequence
atgtccttagattcaagactgccagctttcagaaatctgtctccagctgcaagactagatcacattggccaacttttgggactaagtcatgacgacgtttcccttttagcaaacgccggtgctttaccaatggatatcgctaatggtatgattgaaaatgtaatcgggacctttgaactgccatatgcagtggccagtaactttcagatcaatggccgtgacgtcttagtaccattagttgtggaggaacctagtatcgttgctgcagcctcttacatggcaaagttagctagagccaatggtgggttcactacatcttcatctgctccactaatgcatgcacaagtacaaattgtcggcattcaggatccactaaacgcaagattgtctttactgcgtagaaaggatgagatcatagaattagccaataggaaggaccaacttctgaattcattgggcggtggttgcagagacatagaggtgcatacatttgccgatactccaagaggaccaatgcttgtagcacaccttattgtcgatgtgcgtgatgccatgggagctaatactgttaacactatggctgaagcagtagcacctctgatggaagccataacaggtggccaggtaagattgagaatcctttccaatttggctgatcttagattggccagagcccaagtgagaatcactcctcagcaattggaaactgccgaattctcaggtgaggcagtaattgagggtatcttggacgcatatgcttttgccgctgtggacccttacagagccgctacccacaacaaaggcataatgaacggtatcgatcctttgatcgtcgctacaggaaatgattggagagctgttgaggcaggagctcatgcatacgcttgtagatccggacattacggttcattaacaacatgggaaaaagataacaatggacacttggtcgggacattggaaatgcctatgccagttggtttagttgggggtgctacaaaaacccatcctcttgctcaattgtctttgaggatacttggtgtcaaaactgctcaagcactagccgaaattgccgttgctgttggtttggcacaaaacttgggtgcaatgcgtgctttagctacagaaggcatccaaagaggacatatggctctacacgctagaaacattgcagttgttgcaggagccagaggtgatgaggttgattgggtggctagacaacttgtcgaatatcatgatgtcagagcagacagggctgtggcattactgaaacagaagagaggtcaataa

SEQ ID NO: 78 - protein, 481 aa, Arabidopsis thaliana
MHITKPHAAMFSSPGMGHVIPVIELGKRLSANNGFHVTVFVLETDAASAQSKFLNSTGVDIVKLPSPDIYGLVDPDDHVVTKIGVIMRAAVPALRSKIAAMHQKPTALIVDLFGTDALCLAKEFNMLSYVFIPTNARFLGVSIYYPNLDKDIKEEHTVQRNPLAIPGCEPVRFEDTLDAYLVPDEPVYRDFVRHGLAYPKADGILVNTWEEMEPKSLKSLLNPKLLGRVARVPVYPIGPLCRPIQSSETDHPVLDWLNEQPNESVLYISFGSGGCLSAKQLTELAWGLEQSQQRFVWVVRPPVDGSCCSEYVSANGGGTEDNTPEYLPEGFVSRTSDRGFVVPSWAPQAEILSHRAVGGFLTHCGWSSTLESVVGGVPMIAWPLFAEQNMNAALLSDELGIAVRLDDPKEDISRWKIEALVRKVMTEKEGEAMRRKVKKLRDSAEMSLSIDGGGLAHESLCRVTKECQRFLERVVDLSRGA

SEQ ID NO: 79 - skipped

SEQ ID NO: 80 - protein, 806 aa, Coffea arabica
MAERVLTRVHSLRERLDATLAAHRNDVLLFMSRLETHGKGILKPHQLLAEFEEINKDGKQKIHDHAFEEVLKSTQEAIVLPPWVALAIRLRPGVWEYVRVNVHALVVEELTVPEYLHFKEELVDGSKNGNFVLELDFEPFTASFPKPTLTKYIGDGVEFLNRHLSAKMFHDKESMAPLLDFLRVHQYKGKTMMLNDRIKDLNTLQAVLRKAEEYLTTLSADTPYSEFEHKFQEIGLERGWGDTAERVLEMICMLLDLLGAPDSCTLEKFLGRIPMVFNVVILSPHGYFAQENVLGYPDTGGQVVYILDQVPALEREMLKRIKEQGLDVKPRILIITRLLPDAPGTTCGQRLEKVYGSEYSHILRVPFRTEKGVVRKWISRFEVWPYMETFTEDVAKEVTAELQAKPDLVIGNYSEGNLVASLLAHKLGVTQCTIAHALEKTKYPDSDIYLSKFDEKYHFSCQFTADLIAMNHTDFIITSTFQEIAGSKDTVGQYESHMAFTMPGLYRVVHGIDVFDPKFNIVSPGADTNLYFPHTEKEKRLTSFHPEIEELLFSDVENEEHLCVLKDKKKPILFTMARLDRVKNLTGLVELYAKNPKLRELVNLVVVGGDRRKESKDLEEQAEMKKMYSLIETYNLNGQFRWISSQMNRVRNGELYRYIADTRGAFVQPAFYEAFGLTVVEAMTCGLPTFATNHGGPAEIIIHGKSGFHIDPYHGEQVSELLANFFERCKKEPSYWDTISAGGLKRIQEKYTWQIYSDRLLTLAGVYGFWKCVSKLDRQEIRRYLEMFYALKYRKLAEAVPLAVDQ

SEQ ID NO: 81 - DNA, 19 bp, Artificial Sequence
  Synthetic oligonucleotide
tgaattcgttaacgaattc

SEQ ID NO: 82 - DNA, 19 bp, Artificial Sequence
  Synthetic oligonucleotide
tgaattcgttaacgaactc

SEQ ID NO: 83 - DNA, 19 bp, Artificial Sequence
  Synthetic oligonucleotide
tgaattcgttaacgaagtc

SEQ ID NO: 84 - DNA, 19 bp, Artificial Sequence
  Synthetic oligonucleotide
tgaattcgttaacgaaatt

SEQ ID NO: 85 - protein, 458 aa, Stevia rebaudiana
MENKTETTVRRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTKASSGVIWNSFKELEESELETVIREIPAPSFLIPLPKHLTASSSSLLDHDRTVFQWLDQQPPSSVLYVSFGSTSEVDEKDFLEIARGLVDSKQSFLWVVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 86 - protein, 473 aa, Artificial Sequence
  UGT91D2
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLVPYKAPGISDRCRMGLVLKGSDCLLSKCYHEFGTQWLPLLETLHQVPVVPVGLLPPEIPGDEKDETWVSIKKWLDGKQKGSVVYVALGSEVLVSQTEVVELALGLELSGLPFVWAYRKPKGPAKSDSVELPDGFVERTRDRGLVWTSRAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNARAVAIDHES

SEQ ID NO: 87 - protein, 12 aa, Artificial Sequence
  Synthetic polypeptide
TSFAEYWNLLSP

SEQ ID NO: 88 - protein, 630 aa, Artificial Sequence [sequence omitted]

SEQ ID NO: 89 - protein, 533 aa, Artificial Sequence
  Synthetic polypeptide
MTSFAEYWNLLSPTSFAEYWNLLSPTSFAEYWNLFSPTSFAEYWNLLSPASKMDAMATTEKKPHVIFIPFPAQSHIKAMLKLAQLLHHKGLQITFVNTDFIHNQFLESSGPHCLDGAPGFRFETIPDGVSHSPEASIPIRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 90 - protein, 628 aa, Artificial Sequence
  Synthetic polypeptide
MCNTNMSVPTDGAVTTSQIPASEQETLVRPKPLLLKLLKSVGAQKDTYTMKEVLFYLGQYIMTKRLYDEKQQHIVYCSNDLLGDLFGVPSFSVKEHRKIYTMIYRNLVVVNQQESSDSGTSVSENRCHLEGGSDQKDLVQELQEEKPSSSHLVSRPSTGGSGSSGGSASKMENKTETTVRRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTKASSGVIWNSFKELEESELETVIREIPAPSFLIPLPKHLTASSSSLLDHDRTVFQWLDQQPPSSVLYVSFGSTSEVDEKDFLEIARGLVDSKQSFLWVVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 91 - protein, 643 aa, Artificial Sequence
  Synthetic polypeptide
MCNTNMSVPTDGAVTTSQIPASEQETLVRPKPLLLKLLKSVGAQKDTYTMKEVLFYLGQYIMTKRLYDEKQQHIVYCSNDLLGDLFGVPSFSVKEHRKIYTMIYRNLVVVNQQESSDSGTSVSENRCHLEGGSDQKDLVQELQEEKPSSSHLVSRPSTGGSGSSGGSASKMATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLVPYKAPGISDGYRMGLVLKGSDCLLSKCYHEFGTQWLPLLETLHQVPVVPVGLLPPEIPGDEKDETWVSIKKWLDGKQKGSVVYVALGSEVLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNARAVAIDHES

SEQ ID NO: 92 - protein, 110 aa, Escherichia coli
MNPYIYLGGAILAEVIGTTLMKFSEGFTRLWPSVGTIICYCASFWLLAQTLAYIPTGIAYAIWSGVGIVLISLLSWGFFGQRLDLPAIIGMMLICAGVLIINLLSRSTPH

SEQ ID NO: 93 - protein, 1049 aa, Escherichia coli [sequence omitted]

SEQ ID NO: 94 - protein, 397 aa, Escherichia coli
MNKNRGFTPLAVVLMLSGSLALTGCDDKQAQQGGQQMPAVGVVTVKTEPLQITTELPGRTSAYRIAEVRPQVSGIILKRNFKEGSDIEAGVSLYQIDPATYQATYDSAKGDLAKAQAAANIAQLTVNRYQKLLGTQYISKQEYDQALADAQQANAAVTAAKAAVETARINLAYTKVTSPISGRIGKSNVTEGALVQNGQATALATVQQLDPIYVDVTQSSNDFLRLKQELANGTLKQENGKAKVSLITSDGIKFPQDGTLEFSDVTVDQTTGSITLRAIFPNPDHTLLPGMFVRARLEEGLNPNAILVPQQGVTRTPRGDATVLVVGADDKVETRPIVASQAIGDKWLVTEGLKAGDRVVISGLQKVRPGVQVKAQEVTADNNQQAASGAQPEQSKS

SEQ ID NO: 95 - protein, 457 aa, Escherichia coli
MQKYISEARLLLALAIPVILAQIAQTAMGFVSTVMAGGYSATDMAAVAIGTSIWLPAILFGHGLLLALTPVIAQLNGSGRRERIAHQVRQGFWLAGFVSVLIMLVLWNAGYIIRSMENIDPALADKAVGYLRALLWGAPGYLFFQVARNQCEGLAKTKPGMVMGFIGLLVNIPVNYIFIYGHFGMPELGGVGCGVATAAVYWVMFLAMVSYIKRARSMRDIRNEKGTAKPDPAVMKRLIQLGLPIALALFFEVTLFAVVALLVSPLGIVDVAGHQIALNFSSLMFVLPMSLAAAVTIRVGYRLGQGSTLDAQTAARTGLMVGVCMATLTAIFTVSLREQIALLYNDNPEVVTLAAHLMLLAAVYQISDSIQVIGSGILRGYKDTRSIFYITFTAYWVLGLPSGYILALTDLVVEPMGPAGFWIGFIIGLTSAAIMMMLRMRFLQRLPSAIILQRASR

SEQ ID NO: 96 - DNA, 2358 bp, Arabidopsis thaliana
atgtctattaatttgagatcttccggttgtagctccccaataagcgcaactttggaaaggggtctagactctgaagttcaaacaagagcaaacaatgtatcttttgagcagaccaaagagaagatcaggaaaatgcttgagaaggtcgagttgagcgtgagtgcctatgacactagttgggtagctatggtcccatcaccatccagtcaaaacgcacctcttttcccacagtgcgtcaaatggctacttgataatcaacatgaggacggctcttggggattggataaccacgaccatcagagcttaaagaaagatgtgttgtcatccacattagcctctatcctagctcttaagaaatggggaataggcgaaagacagatcaataagggtctacagttcattgaattaaactctgcactagttaccgatgaaactatacaaaaacctacaggtttcgacatcatttttccaggaatgattaagtacgccagggaccttaatttgaccatacctcttggctcagaagtagtcgacgatatgatcaggaaaagagatctagacttaaagtgtgatagcgagaaattcagcaaaggtagagaggcttatcttgcctatgttcttgaaggaactaggaacttgaaggactgggacttaattgtgaaatatcagagaaagaacggtagtctatttgatagtccagctacaaccgccgcagctttcactcaatttggcaatgacggttgcttgaggtacttatgttcacttttacagaaattcgaggccgcagtgcctagtgtatatccatttgatcaatacgctagattaagcataatcgtcactttagaatcattgggaattgacagagatttcaagactgagataaaaagcatattggatgagacctataggtactggcttagaggtgacgaagaaatttgcctagatttggccacatgtgcacttgcttttaggttgcttttagcccacggctatgacgtgtcatacgatcctctaaagccatttgcagaggaatctggtttcagcgatacccttgagggatatgttaaaaacaccttttccgtattagagcttttcaaggctgcccaaagttaccctcatgagagtgctttgaaaaagcagtgttgctggacaaaacaatatctagaaatggaactaagttcatgggttaaaacaagcgttagggacaagtacttgaaaaaggaagtggaggatgctttggcatttccatcatatgcctctttagaaagaagtgaccacagaaggaaaattcttaatggctcagcagttgaaaacacaagagtaaccaagacctcttacaggttgcataatatatgtacatcagatatcttaaaacttgctgtcgacgatttcaacttttgccaatctattcatagagaggaaatggaaagattggatagatggatagtggagaatagactacaggaattaaagttcgccagacaaaaattggcttactgttactttagtggcgctgccacactattctctccagaattgtctgacgcaaggatctcatgggctaagggaggtgttctaaccacagtagtcgatgacttttttgatgttggcggtagtaaagaagagcttgagaacttaattcacttggtggaaaagtgggatcttaatggagttcctgaatactcttcagagcatgtagaaataattttctctgtcctaagagacactatcttagaaaccggtgataaagcctttacatatcagggcagaaacgttactcaccatattgtgaaaatatggttggacttacttaagagcatgctaagggaggctgaatggtccagtgacaaatcaaccccatctttggaagattacatggagaatgcctatatcagcttcgcattaggtcctattgtattgccagctacataccttataggacctccactacctgaaaagactgtcgactcccaccaatataatcaattatacaaattggttagtaccatgggtagactattaaacgatatccagggctttaagagggaatcagccgagggaaaacttaatgcagtgtctctacatatgaagcatgaaagagacaacagaagcaaagaggttattatagaatccatgaaaggattggctgaaaggaaaagagaggaattacacaaacttgtactagaagagaaaggtagtgtcgttccaagagaatgcaaggaagccttcttaaaaatgtcaaaagtgttgaaccttttttataggaaggatgatggcttcacatctaacgacttgatgagccttgtgaaatccgtcatctacgagcctgtttcacttcaaaaggagagtctaacttga

SEQ ID NO: 97 - DNA, 894 bp, Artificial Sequence
  Codon-optimized nucleotide sequence encoding Synechococcus sp. GGPPS
atggtcgcacaaactttcaacctggatacctacttatcccaaagacaacaacaagttgaagaggccctaagtgctgctcttgtgccagcttatcctgagagaatatacgaagctatgagatactccctcctggcaggtggcaaaagattaagacctatcttatgtttagctgcttgcgaattggcaggtggttctgttgaacaagccatgccaactgcgtgtgcacttgaaatgatccatacaatgtcactaattcatgatgacctgccagccatggataacgatgatttcagaagaggaaagccaactaatcacaaggtgttcggggaagatatagccatcttagcgggtgatgcgcttttagcttacgcttttgaacatattgcttctcaaacaagaggagtaccacctcaattggtgctacaagttattgctagaatcggacacgccgttgctgcaacaggcctcgttggaggccaagtcgtagaccttgaatctgaaggtaaagctatttccttagaaacattggagtatattcactcacataagactggagccttgctggaagcatcagttgtctcaggcggtattctcgcaggggcagatgaagagcttttggccagattgtctcattacgctagagatataggcttggcttttcaaatcgtcgatgatatcctggatgttactgctacatctgaacagttggggaaaaccgctggtaaagaccaggcagccgcaaaggcaacttatccaagtctattgggtttagaagcctctagacagaaagcggaagagttgattcaatctgctaaggaagccttaagaccttacggttcacaagcagagccactcctagcgctggcagacttcatcacacgtcgtcagcattaa

SEQ ID NO: 98 - DNA, 1542 bp, Artificial Sequence
  Codon-optimized nucleotide sequence encoding S. rebaudiana KO-1
atggatgctgtgacgggtttgttaactgtcccagcaaccgctataactattggtggaactgctgtagcattggcggtagcgctaatcttttggtacctgaaatcctacacatcagctagaagatcccaatcaaatcatcttccaagagtgcctgaagtcccaggtgttccattgttaggaaatctgttacaattgaaggagaaaaagccatacatgacttttacgagatgggcagcgacatatggacctatctatagtatcaaaactggggctacaagtatggttgtggtatcatctaatgagatagccaaggaggcattggtgaccagattccaatccatatctacaaggaacttatctaaagccctgaaagtacttacagcagataagacaatggtcgcaatgtcagattatgatgattatcataaaacagttaagagacacatactgaccgccgtcttgggtcctaatgcacagaaaaagcatagaattcacagagatatcatgatggataacatatctactcaacttcatgaattcgtgaaaaacaacccagaacaggaagaggtagaccttagaaaaatctttcaatctgagttattcggcttagctatgagacaagccttaggaaaggatgttgaaagtttgtacgttgaagacctgaaaatcactatgaatagagacgaaatctttcaagtccttgttgttgatccaatgatgggagcaatcgatgttgattggagagacttctttccatacctaaagtgggtcccaaacaaaaagttcgaaaatactattcaacaaatgtacatcagaagagaagctgttatgaaatctttaatcaaagagcacaaaaagagaatagcgtcaggcgaaaagctaaatagttatatcgattaccttttatctgaagctcaaactttaaccgatcagcaactattgatgtccttgtgggaaccaatcattgaatcttcagatacaacaatggtcacaacagaatgggcaatgtacgaattagctaaaaaccctaaattgcaagataggttgtacagagacattaagtccgtctgtggatctgaaaagataaccgaagagcatctatcacagctgccttacattacagctattttccacgaaacactgagaagacactcaccagttcctatcattcctctaagacatgtacatgaagataccgttctaggcggctaccatgttcctgctggcacagaacttgccgttaacatctacggttgcaacatggacaaaaacgtttgggaaaatccagaggaatggaacccagaaagattcatgaaagagaatgagacaattgattttcaaaagacgatggccttcggtggtggtaagagagtttgtgctggttccttgcaagcccttttaactgcatctattgggattgggagaatggttcaagagttcgaatggaaactgaaggatatgactcaagaggaagtgaacacgataggcctaactacacaaatgttaagaccattgagagctattatcaaacctaggatctaa

SEQ ID NO: 99 - DNA, 2139 bp, Artificial Sequence
  Codon optimized nucleotide seqeunce encoding A. thaliana ATR2
atgtcttcctcttcctcttccagtacctctatgattgatttgatggctgctattattaaaggtgaaccagttatcgtctccgacccagcaaatgcctctgcttatgaatcagttgctgcagaattgtcttcaatgttgatcgaaaacagacaattcgccatgatcgtaactacatcaatcgctgttttgatcggttgtattgtcatgttggtatggagaagatccggtagtggtaattctaaaagagtcgaacctttgaaaccattagtaattaagccaagagaagaagaaatagatgacggtagaaagaaagttacaatatttttcggtacccaaactggtacagctgaaggttttgcaaaagccttaggtgaagaagctaaggcaagatacgaaaagactagattcaagatagtcgatttggatgactatgccgctgatgacgatgaatacgaagaaaagttgaagaaagaagatgttgcatttttctttttggcaacctatggtgacggtgaaccaactgacaatgcagccagattctacaaatggtttacagagggtaatgatcgtggtgaatggttgaaaaacttaaagtacggtgttttcggtttgggtaacagacaatacgaacatttcaacaaagttgcaaaggttgtcgacgatattttggtcgaacaaggtgctcaaagattagtccaagtaggtttgggtgacgatgaccaatgtatagaagatgactttactgcctggagagaagctttgtggcctgaattagacacaatcttgagagaagaaggtgacaccgccgttgctaccccatatactgctgcagtattagaatacagagtttccatccatgatagtgaagacgcaaagtttaatgatatcactttggccaatggtaacggttatacagttttcgatgcacaacacccttacaaagctaacgttgcagtcaagagagaattacatacaccagaatccgacagaagttgtatacacttggaatttgatatcgctggttccggtttaaccatgaagttgggtgaccatgtaggtgttttatgcgacaatttgtctgaaactgttgatgaagcattgagattgttggatatgtcccctgacacttattttagtttgcacgctgaaaaagaagatggtacaccaatttccagttctttaccacctccattccctccatgtaacttaagaacagccttgaccagatacgcttgcttgttatcatcccctaaaaagtccgccttggttgctttagccgctcatgctagtgatcctactgaagcagaaagattgaaacacttagcatctccagccggtaaagatgaatattcaaagtgggtagttgaatctcaaagatcattgttagaagttatggcagaatttccatctgccaagcctccattaggtgtcttctttgctggtgtagcacctagattgcaaccaagattctactcaatcagttcttcacctaagatcgctgaaactagaattcatgttacatgtgcattagtctacgaaaagatgccaaccggtagaattcacaagggtgtatgctctacttggatgaaaaatgctgttccttacgaaaaatcagaaaagttgttcttaggtagaccaatcttcgtaagacaatcaaacttcaagttgccttctgattcaaaggttccaataatcatgataggtcctggtacaggtttagccccattcagaggtttcttgcaagaaagattggctttagttgaatctggtgtcgaattaggtccttcagttttgttctttggttgtagaaacagaagaatggatttcatctatgaagaagaattgcaaagattcgtcgaatctggtgcattggccgaattatctgtagctttttcaagagaaggtccaactaaggaatacgttcaacataagatgatggataaggcatccgacatatggaacatgatcagtcaaggtgcttatttgtacgtttgcggtgacgcaaagggtatggccagagatgtccatagatctttgcacacaattgctcaagaacaaggttccatggatagtaccaaagctgaaggtttcgtaaagaacttacaaacttccggtagatacttgagagatgtctggtga

SEQ ID NO: 100 - DNA, 1555 bp, Stevia rebaudiana
atggcggaacaacaaaagatcaagaaatcaccacacgttctactcatcccattccctttacaaggccatataaaccctttcatccagtttggcaaacgattaatctccaaaggtgtcaaaacaacacttgttaccaccatccacaccttaaactcaaccctaaaccacagtaacaccaccaccacctccatcgaaatccaagcaatttccgatggttgtgatgaaggcggttttatgagtgcaggagaatcatatttggaaacattcaaacaagttgggtctaaatcactagctgacttaatcaagaagcttcaaagtgaaggaaccacaattgatgcaatcatttatgattctatgactgaatgggttttagatgttgcaattgagtttggaatcgatggtggttcgtttttcactcaagcttgtgttgtaaacagcttatattatcatgttcataagggtttgatttctttgccattgggtgaaactgtttcggttcctggatttccagtgcttcaacggtgggagacaccgttaattttgcagaatcatgagcaaatacagagcccttggtctcagatgttgtttggtcagtttgctaatattgatcaagcacgttgggtcttcacaaatagtttttacaagctcgaggaagaggtaatagagtggacgagaaagatatggaacttgaaggtaatcgggccaacacttccatccatgtaccttgacaaacgacttgatgatgataaagataacggatttaatctctacaaagcaaaccatcatgagtgcatgaactggttagacgataagccaaaggaatcagttgtttacgtagcatttggtagcctggtgaaacatggacccgaacaagtggaagaaatcacacgggctttaatagatagtgatgtcaacttcttgtgggttatcaaacataaagaagagggaaagctcccagaaaatctttcggaagtaataaaaaccggaaagggtttgattgtagcatggtgcaaacaattggatgtgttagcacacgaatcagtaggatgctttgttacacattgtgggttcaactcaactcttgaagcaataagtcttggagtccccgttgttgcaatgcctcaattttcggatcaaactacaaatgccaagcttctagatgaaattttgggtgttggagttagagttaaggctgatgagaatgggatagtgagaagaggaaatcttgcgtcatgtattaagatgattatggaggaggaaagaggagtaataatccgaaagaatgcggtaaaatggaaggatttggctaaagtagccgttcatgaaggtggtagctcagacaatgatattgtcgaatttgtaagtgagctaattaaggcttaaatttttgttgctttgtattttatgtgttatggttttttgatttagatgtattcaattaatattgaatcataactaaattcaagattattgtttgtaatattctttgtcctaaaattttgcgacttaaaacctttagtttataaaaagaaattagaaaatactattgcacgga

SEQ ID NO: 101 - DNA, 1377 bp, Artificial Sequence
  Codon-optimized S. rebaudiana UGT76G1
atggaaaacaagaccgaaacaacagttagacgtaggcgtagaatcattctgtttccagtaccttttcaagggcacatcaatccaatactacaactagccaacgttttgtactctaaaggtttttctattacaatctttcacaccaatttcaacaaaccaaaaacatccaattacccacatttcacattcagattcatacttgataatgatccacaagatgaacgtatttcaaacttacctacccacggtcctttagctggaatgagaattccaatcatcaatgaacatggtgccgatgagcttagaagagaattagagttacttatgttggcatccgaagaggacgaggaagtctcttgtctgattactgacgctctatggtactttgcccaatctgtggctgatagtttgaatttgaggagattggtactaatgacatccagtctgtttaactttcacgctcatgttagtttaccacaatttgacgaattgggatacttggaccctgatgacaagactaggttagaggaacaggcctctggttttcctatgttgaaagtcaaagatatcaagtctgcctattctaattggcaaatcttgaaagagatcttaggaaagatgatcaaacagacaaaggcttcatctggagtgatttggaacagtttcaaagagttagaagagtctgaattggagactgtaatcagagaaattccagcaccttcattcctgataccattaccaaaacatttgactgcttcctcttcctctttgttggatcatgacagaacagtttttcaatggttggaccaacaaccacctagttctgttttgtacgtgtcatttggtagtacttctgaagtcgatgaaaaggacttccttgaaatcgcaagaggcttagtcgatagtaagcagtcattcctttgggtcgtgcgtccaggtttcgtgaaaggctcaacatgggtcgaaccacttccagatggttttctaggcgaaagaggtagaatagtcaaatgggttcctcaacaggaagttttagctcatggcgctattggggcattctggactcattccggatggaattcaactttagaatcagtatgcgaaggggtacctatgatcttttcagattttggtcttgatcaaccactgaacgcaagatacatgtctgatgttttgaaagtgggtgtatatctagaaaatggctgggaaaggggtgaaatagctaatgcaataagacgtgttatggttgatgaagagggggagtatatcagacaaaacgcaagagtgctgaagcaaaaggccgacgtttctctaatgaagggaggctcttcatacgaatccttagaatctcttgtttcctacatttcatcactgtaa

SEQ ID NO: 102 - DNA, 1422 bp, Artificial Sequence
  Codon-optimized nucleotide sequence encoding S. rebaudiana UGT91D2e-b
atggctacttctgattccatcgttgacgatagaaagcaattgcatgttgctacttttccatggttggctttcggtcatattttgccatacttgcaattgtccaagttgattgctgaaaagggtcacaaggtttcattcttgtctaccaccagaaacatccaaagattgtcctctcatatctccccattgatcaacgttgttcaattgactttgccaagagtccaagaattgccagaagatgctgaagctactactgatgttcatccagaagatatcccttacttgaaaaaggcttccgatggtttacaaccagaagttactagattcttggaacaacattccccagattggatcatctacgattatactcattactggttgccatccattgctgcttcattgggtatttctagagcccatttctctgttactactccatgggctattgcttatatgggtccatctgctgatgctatgattaacggttctgatggtagaactaccgttgaagatttgactactccaccaaagtggtttccatttccaacaaaagtctgttggagaaaacacgatttggctagattggttccatacaaagctccaggtatttctgatggttacagaatgggtatggttttgaaaggttccgattgcttgttgtctaagtgctatcatgaattcggtactcaatggttgcctttgttggaaacattgcatcaagttccagttgttccagtaggtttgttgccaccagaaattccaggtgacgaaaaagacgaaacttgggtttccatcaaaaagtggttggatggtaagcaaaagggttctgttgtttatgttgctttgggttccgaagctttggtttctcaaaccgaagttgttgaattggctttgggtttggaattgtctggtttgccatttgtttgggcttacagaaaacctaaaggtccagctaagtctgattctgttgaattgccagatggtttcgttgaaagaactagagatagaggtttggtttggacttcttgggctccacaattgagaattttgtctcatgaatccgtctgtggtttcttgactcattgtggttctggttctatcgttgaaggtttgatgtttggtcacccattgattatgttgccaatctttggtgaccaaccattgaacgctagattattggaagataagcaagtcggtatcgaaatcccaagaaatgaagaagatggttgcttgaccaaagaatctgttgctagatctttgagatccgttgtcgttgaaaaagaaggtgaaatctacaaggctaacgctagagaattgtccaagatctacaacgataccaaggtcgaaaaagaatacgtttcccaattcgttgactacttggaaaagaatgctagagctgttgccattgatcatgaatcttga

SEQ ID NO: 103 - DNA, 2343 bp, Artificial Sequence
  Truncated CDPS from Zea mays
atggcacagcacacatcagaatccgcagctgtcgcaaagggcagcagtttgacccctatagtgagaactgacgctgagtcaaggagaacaagatggccaaccgatgacgatgacgccgaacctttagtggatgagatcagggcaatgcttacttccatgtctgatggtgacatttccgtgagcgcatacgatacagcctgggtcggattggttccaagattagacggcggtgaaggtcctcaatttccagcagctgtgagatggataagaaataaccagttgcctgacggaagttggggcgatgccgcattattctctgcctatgacaggcttatcaatacccttgcctgcgttgtaactttgacaaggtggtccctagaaccagagatgagaggtagaggactatcttttttgggtaggaacatgtggaaattagcaactgaagatgaagagtcaatgcctattggcttcgaattagcatttccatctttgatagagcttgctaagagcctaggtgtccatgacttcccttatgatcaccaggccctacaaggaatctactcttcaagagagatcaaaatgaagaggattccaaaagaagtgatgcataccgttccaacatcaatattgcacagtttggagggtatgcctggcctagattgggctaaactacttaaactacagagcagcgacggaagttttttgttctcaccagctgccactgcatatgctttaatgaataccggagatgacaggtgttttagctacatcgatagaacagtaaagaaattcaacggcggcgtccctaatgtttatccagtggatctatttgaacatatttgggccgttgatagacttgaaagattaggaatctccaggtacttccaaaaggagatcgaacaatgcatggattatgtaaacaggcattggactgaggacggtatttgttgggcaaggaactctgatgtcaaagaggtggacgacacagctatggcctttagacttcttaggttgcacggctacagcgtcagtcctgatgtgtttaaaaacttcgaaaaggacggtgaatttttcgcatttgtcggacagtctaatcaagctgttaccggtatgtacaacttaaacagagcaagccagatatccttcccaggcgaggatgtgcttcatagagctggtgccttctcatatgagttcttgaggagaaaagaagcagagggagctttgagggacaagtggatcatttctaaagatctacctggtgaagttgtgtatactttggattttccatggtacggcaacttacctagagtcgaggccagagactacctagagcaatacggaggtggtgatgacgtttggattggcaagacattgtataggatgccacttgtaaacaatgatgtatatttggaattggcaagaatggatttcaaccactgccaggctttgcatcagttagagtggcaaggactaaaaagatggtatactgaaaataggttgatggactttggtgtcgcccaagaagatgcccttagagcttattttcttgcagccgcatctgtttacgagccttgtagagctgccgagaggcttgcatgggctagagccgcaatactagctaacgccgtgagcacccacttaagaaatagcccatcattcagagaaaggttagagcattctcttaggtgtagacctagtgaagagacagatggctcctggtttaactcctcaagtggctctgatgcagttttagtaaaggctgtcttaagacttactgattcattagccagggaagcacagccaatccatggaggtgacccagaagatattatacacaagttgttaagatctgcttgggccgagtgggttagggaaaaggcagacgctgccgatagcgtgtgcaatggtagttctgcagtagaacaagagggatcaagaatggtccatgataaacagacctgtctattattggctagaatgatcgaaatttctgccggtagggcagctggtgaagcagccagtgaggacggcgatagaagaataattcaattaacaggctccatctgcgacagtcttaagcaaaaaatgctagtttcacaggaccctgaaaaaaatgaagagatgatgtctcacgtggatgacgaattgaagttgaggattagagagttcgttcaatatttgcttagactaggtgaaaaaaagactggatctagcgaaaccaggcaaacatttttaagtatagtgaaatcatgttactatgctgctcattgcccacctcatgtcgttgatagacacattagtagagtgattttcgagccagtaagtgccgcaaagtaaccgcgg

SEQ ID NO: 104 - protein, 1068 aa, Saccharomyces cerevisiae
MRGLTPKNGVHIETGPDTESSADSSNFSTGFSGKIRKPRSKVSKACDNCRKRKIKCNGKFPCASCEIYSCECTFSTRQGGARIKNLHKTSLEGTTVQVKEETDSSSTSFSNPQRCTDGPCAVEQPTKFFENFKLGGRSSGDNSGSDGKNDDDVNRNGFYEDDSESQATLTSLQTTLKNLKEMAHLGTHVTSAIESIELQISDLLKRWEPKVRTKELATTKFYPNKSIETQLMKNKYCDVVHLTRYAAWSNNKKDQDTSSQPLIDEIFGLYSPFQFLSLQGIGKCFQNYRSKSKCEIFPRTAKETIYIMLRFFDVCFHHINQGCVSIANPLENYLQKMNLLPSTPSSISSAGSPNTAHTKSHVALVINHLPQPFVRNITGISNSELLSEMNNDISMFGILLKMLDMHKNSYQNFLMEITSNPSVAKNTQSIDVLQEFIHYCQAGEALIALCYSYYNSTLYNYVDFTCDITHLEQLLYFLDLLFWLSEIYGFEKVLNVAVHFVSRVGLSRWEFYVGLDENFAERRRNLWWKAFYFEKTLASKLGYPSNIDDSKINCLLPKNFRDVGFLDNRDFIENVHLVRRSEAFDNMCISDLKYYGELAVLQIVSHFSSSVLFNEKFTSIRNTSKPSVVREKLLFEVLEIFNETEMKYDAIKEQTGKLFDIAFSKDSTELKVSREDKIMASKFVLFYEHHFCRMVNESDNIVARLCVHRRPSILIENLKIYLHKIYKSWTDMNKILLDFDNDYSVYRSFAHYSISCIILVSQAFSVAEFIKVNDVVNMIRVFKRFLDIKIFSENETNEHVFNSQSFKDYTRAFSFLTIVTRIMLLAYGESSSTNLDVISKYIDENAPDLKGIIELVLDTNSCAYRFLLEPVQKSGFHLTVSQMLKNRKFQEPLMSNEDNKQMKHNSGKNLNPDLPSLKTGTSCLLNGIESPQLPFNGRSAPSPVRNNSLPEFAQLPSFRSLSVSDMINPDYAQPTNGQNNTQVQSNKPINAQQQIPTSVQVPFMNTNEINNNNNNNNNNKNNINNINNNNSNNFSATSFNLGTLDEFVNNGDLEDLYSILWSDVYPDS

SEQ ID NO: 105 - protein, 976 aa, Saccharomyces cerevisiae
MKVKKSTRSKVSTACVNCRKRKIKCTGKYPCTNCISYDCTCVFLKKHLPQKEDSSQSLPTTAVAPPSSHANVEASADVQHLDTAIKLDNQYYFKLMNDLIQTPVSPSATHAPDTSNNPTNDNNILFKDDSKYQNQLVTYQNILTNLYALPPCDDTQLLIDKTKSQLNNLINSWNPEINYPKLSSFSPRPQRSIETYLLTNKYRNKIHMTRFSFWTDQMVKSQSPDSFLATTPLVDEVFGLFSPIQAFSLRGIGYLIKKNIENTGSSMLIDTKETIYLILRLFDLCYEHLIQGCISISNPLENYLQKIKQTPTTTASASLPTSPAPLSNDLVISVIHQLPQPFIQSITGFTTTQLIENLHDSFSMFRIVTQMYAQHRKRFAEFLNQAFSLPHQEKSVLFSSFCSSEYLLSTLCYAYYNVTLYHMLDINTLDYLEILVSLLEIQNEIDERFGFEKMLEVAVTCSTKMGLSRWEYYVGIDENTAERRRKIWWKIYSLEKRFLTDLGDLSLINEHQMNCLLPKDFRDMGFINHKEFLTKIGTSSLSPSSPKLKNLSLSRLIEYGELAIAQIVGDFFSETLYNEKFTSLEVSVKPTIIRQKLLEKVFEDIESFRLKLAKIKLHTSRVFQVAHCKYPEYPKNDLIEAAKFVSYHKNTWFSILGAVNNLIARLSEDPEVITEQSMKYANEMFQEWREINQFLIQVDTDFIVWACLDFYELIFFVMASKFYVEDPHITLEDVINTLKVFKRITNIISFFNNNLDEKDYDCQTFREFSRSSSLVAISIRIIFLKYCYAEQIDRAEFIERLKEVEPGLSDLLREFFDTRSFIYRYMLKSVEKSGFHLIIRKMLESDYKFLYRDKLATGNIPDQGNSSQISQLYDSTAPSYNNASASAANSPLKLSSLLNSGEESYTQDASENVPCNLRHQDRSLQQTKRQHSAPSQISANENNIYNLGTLEEFVSSGDLTDLYHTLWNDNTSYPFL

SEQ ID NO: 106 - protein, 701 aa, Saccharomyces cerevisiae
MDGSHFPMKSTTGEPVSSGKKGKRRKVIKSCAFCRKRKLKCSQARPMCQQCVIRKLPQCVYTEEFNYPLSNTELFEQVPNVALVQKIENLQTLLKENDNNNAKPVYCRSSENPLRSLRTSVLGDNGSRYVFGPTSWKTLSLFEQNKFQTEFQNLWKVLKPLPECTKSQLNENDVVADLPSFPQMESCIKSFFAGPLFGILHIFNQDDILSLLDRLFIRDTTDKNLVILLDLQGNAKDKYNLGIVLQILCLGYYNQDIPSSVSHFLHTLSAASLSSSSSNFVEKLQFFLLSYISVMINCTDGVWDATQGVDLINELCQGCISLGLNDIDKWYLNESEETKQNLRCIWFWALFLDVSTSYDIGNPPSISDDLLDLSIFTAQNFQSPSIDFRRVKLMHDFLDVSRFTTREIHKREMNEKLTTFSLRLIEFIQSNFSPIEHYTNSVYYSDIDPFDILILSRSLSIVASIYNIEMIIAQQSRIIDKNRMVQFLLISISVCVNTMVFHFKEPINDQENVLTEGLKLSIILINPLLIRIVSQVYSLAFNRLIFREKAFLFLIDLDTGKKIQFIKYEEENFDELLTGFDVRTDKFLSFSGTIIRFYEIIDSIFAVNERNKRLLKAVSNFYQLTSTLAFERVSRVLFDKASQARIETEKIWLKKGINMEHFSDLMIEDFINDVWKTFKEISKDLWSIDKKKFYKQYHFDL

SEQ ID NO: 107 - protein, 1511 aa, Saccharomyces cerevisiae
MPEAKLNNNVNDVTSYSSASSSTENAADLHNYNGFDEHTEARIQKLARTLTAQSMQNSTQSAPNKSDAQSIFSSGVEGVNPIFSDPEAPGYDPKLDPNSENFSSAAWVKNMAHLSAADPDFYKPYSLGCAWKNLSASGASADVAYQSTVVNIPYKILKSGLRKFQRSKETNTFQILKPMDGCLNPGELLVVLGRPGSGCTTLLKSISSNTHGFDLGADTKISYSGYSGDDIKKHFRGEVVYNAEADVHLPHLTVFETLVTVARLKTPQNRIKGVDRESYANHLAEVAMATYGLSHTRNTKVGNDIVRGVSGGERKRVSIAEVSICGSKFQCWDNATRGLDSATALEFIRALKTQADISNTSATVAIYQCSQDAYDLFNKVCVLDDGYQIYYGPADKAKKYFEDMGYVCPSRQTTADFLTSVTSPSERTLNKDMLKKGIHIPQTPKEMNDYWVKSPNYKELMKEVDQRLLNDDEASREAIKEAHIAKQSKRARPSSPYTVSYMMQVKYLLIRNMWRLRNNIGFTLFMILGNCSMALILGSMFFKIMKKGDTSTFYFRGSAMFFAILFNAFSSLLEIFSLYEARPITEKHRTYSLYHPSADAFASVLSEIPSKLIIAVCFNIIFYFLVDFRRNGGVFFFYLLINIVAVFSMSHLFRCVGSLTKTLSEAMVPASMLLLALSMYTGFAIPKKKILRWSKWIWYINPLAYLFESLLINEFHGIKFPCAEYVPRGPAYANISSTESVCTVVGAVPGQDYVLGDDFIRGTYQYYHKDKWRGFGIGMAYVVFFFFVYLFLCEYNEGAKQKGEILVFPRSIVKRMKKRGVLTEKNANDPENVGERSDLSSDRKMLQESSEEESDTYGEIGLSKSEAIFHWRNLCYEVQIKAETRRILNNVDGWVKPGTLTALMGASGAGKTTLLDCLAERVTMGVITGDILVNGIPRDKSFPRSIGYCQQQDLHLKTATVRESLRFSAYLRQPAEVSIEEKNRYVEEVIKILEMEKYADAVVGVAGEGLNVEQRKRLTIGVELTAKPKLLVFLDEPTSGLDSQTAWSICQLMKKLANHGQAILCTIHQPSAILMQEFDRLLFMQRGGKTVYFGDLGEGCKTMIDYFESHGAHKCPADANPAEWMLEVVGAAPGSHANQDYYEVWRNSEEYRAVQSELDWMERELPKKGSITAAEDKHEFSQSIIYQTKLVSIRLFQQYWRSPDYLWSKFILTIFNQLFIGFTFFKAGTSLQGLQNQMLAVFMFTVIFNPILQQYLPSFVQQRDLYEARERPSRTFSWISFIFAQIFVEVPWNILAGTIAYFIYYYPIGFYSNASAAGQLHERGALFWLFSCAFYVYVGSMGLLVISFNQVAESAANLASLLFTMSLSFCGVMTTPSAMPRFWIFMYRVSPLTYFIQALLAVGVANVDVKCADYELLEFTPPSGMTCGQYMEPYLQLAKTGYLTDENATDTCSFCQISTTNDYLANVNSFYSERWRNYGIFICYIAFNYIAGVFFYWLARVPKKNGKLSKK

SEQ ID NO: 108 - protein, 1564 aa, Saccharomyces cerevisiae
MLQAPSSSNSGLNQGNAAPDGPPNETQPYEGLDAAAQEEIKELARTLTSQSSLLSQEKRITGTGDPNTLTAASSSSLSRSIFASDIKGVNPILLDVNDPDYDETLDPRSENFSSVRWVRNMAQICENDSDFYKPFSLGCAWKDLSASGDSADITYQGTFGNMPIKYLKMSWRCISRRLFHRTHGKSEDNDSGFQILKPMDGCINPGELLVVLGRPGAGCTTLLKSISVNTHGFKISPDTIITYNGFSNKEIKNHYRGEVVYNAESDIHIPHLTVFQTLYTVARLKTPRNRIKGVDRDTFAKHMTEVAMATYGLSHTADTKVGNDFVRGVSGGERKRVSIAEVSICGSKFQCWDNATRGLDSATALEFIKALKTQATITKSAATVAIYQCSKDAYDLFDKVCVLYDGYQIFFGPSKQAKKYFQRMGYVCPERQTTADYLTSITSPSERIKDKDMVKHGIMIPQTAYEMNQYWIQSEEYKQLQVQVNKHLDTDSSQQREQIKNAHIAKQSKRARPSSPYTVSFFLQVKYILIRDIWRIKNDPSIQLFTVLSHAAMALILGSMFYEVMLSTTTTTFYYRGAAIFFAILFNAFSSLLEIFSLYETRPITEKHKTYSLYRPSADAFASTFSDVPTKLATAVTFNIPYYFLINLKRDAGAFFFYFLINIITVFAMSHLFRCIGSVSKTLPQAMVPASVLLLAFAMYTGFAIPRVQMLGWSKWISYINPLSYLFESLMINEFHGRNFPCAQYIPSGPNYVNATGDEVTCSALGSIPGNNYVSGDDFIQTNYGYRHKNKWRSVGIGLAYIIFFLFLYLFFCEYNEGAKQNGEMLVFPHSVVKKMKKKGIVSEKKKKNQPTLSTSDAEKDVEMNNNSSATDSRFLRDSDAAIMGNDKTVAKEHYSSPSSSASQSNSFSKSDDIELSKSQAIFHWKNLCYDIPIKNGKRRILDNVDGWVKPGTLTALIGASGAGKTTLLDCLAERTTMGLITGDVFVDGRPRDQSFPRSIGYCQQQDLHLKTATVRESLRFSAYLRQADDVSIEEKDKYVEEVIEVLEMKLYADAIVGVPGEGLNVEQRKRLTIGVELAAKPKLLVFLDEPTSGLDSQTAWSTCQLMKKLASRGQAILCTIHQPSALLMQEFDRLLFLQEGGQTVYFGELGKGCKTMINYFEAHGAHKCPPDANPAEWMLEIVGAAPGTHASQDYFAIWRDSEEYREMQKELDWMERELPKRTEGSSNEEQKEFATSTLYQIKLVSYRLFHQYWRTPFYLWSKFFSTIVSELFIGFTFFKANTSLQGLQNQMLAIFMFTVVFNPILQQYLPLFVQQRELYEARERPSRTFSWKAFIVSQILVEIPWNLLAGTIAFFVYYYPVGFYRNASYANQLHERGALFWLFACAFYVYISSMGVLVISCIEIAENAANLASLFFIMSLSFCGVLATPNILPRFWIFMYRVSPLTYLIDALLSVGLANASVVCSSNELLKIVPPSGMTCSEYMEPYMQSTGTGYLLDGSSETECHFCQFSSTNDYLATVSSSYSRRWMNYGIFSAYIVFDYCAAIFLYWLVRVPKKSKKLKK

SEQ ID NO: 109 - protein, 1411 aa, Saccharomyces cerevisiae
MSLSKYFNPIPDASVTFDGATVQLEESLGAVQNDEESASEFKNVGHLEISDITFRANEGEVVLVLGNPTSALFKGLFHGHKHLKYSPEGSIRFKDNEYKQFASKCPHQIIYNNEQDIHFPYLTVEQTIDFALSCKFHIPKQERIEMRDELLKEFGLSHVKKTYVGNDYVRGVSGGERKRISIIETFIANGSVYLWDNSTKGLDSATALEFLSITQKMAKATRSVNFVKISQASDKIVSKFDKILMLGDSFQVFYGTMEECLTHFHDTLQIKKNPNDCIIEYLTSILNFKFKETSNSIVGLDTPSVVSEENQALNINNETDLHTLWIQSPYYKHWKAITSKTVQECTRKDVNPDDISPIFSIPLKTQLKTCTVRAFERIIGDRNYLISQFVSVVVQSLVIGSLFYNIPLTTIGSFSRGSLTFFSILFFTFLSLADMPASFQRQPVVRKHVQLHFYYNWVETLATNFFDCCSKFILVVIFTIILYFLAHLQYNAARFFIFLLFLSVYNFCMVSLFALTALIAPTLSMANLLAGILLLAIAMYASYVIYMKDMHPWFIWIAYLNPAMFAMEAILSNELFNLKLDCHESIIPRGEYYDNISFSHKACAWQGATLGNDYVRGRDYLKSGLKYTYHHVWRNFGIIIGFLCFFLFCSLLAAEYITPLFTRENLLRWNNYLKRYCPFLNSQKKNNKSAITNNDGVCTPKTPIANFSTSSSSVPSVSHQYDTDYNIKHPDETVNNHTKESVAMETQKHVISWKNINYTIGDKKLINDASGYISSGLTALMGESGAGKTTLLNVLSQRTESGVVTGELLIDGQPLTNIDAFRRSIGFVQQQDVHLELLTVRESLEISCVLRGDGDRDYLGVVSNLLRLPSEKLVADLSPTQRKLLSIGVELVTKPSLLLFLDEPTSGLDAEAALTIVQFLKKLSMQGQAILCTIHQPSKSVISYFDNIYLLKRGGECVYFGSLPNACDYFVAHDRRLTFDREMDNPADFVIDVVGSGSTNIPMDDAEKPTSSKIDEPVSYHKQSDSINWAELWQSSPEKVRVADDLLLLEEEARKSGVDFTTSVWSPPSYMEQIKLITKRQYICTKRDMTYVFAKYALNAGAGLFIGFSFWRTKHNINGLQDAIFLCFMMLCVSSPLINQVQDKALQSKEVYIAREARSNTYHWTVLLIAQTIVELPLAISSSTLFFLCCYFCCGFETSARVAGVFYLNYILFSMYYLSFGLWLLYSAPDLQTAAVFVAFLYSFTASFCGVMQPYSLFPRFWTFMYRVSPYTYFIETFVSLLLHDREVNCSTSEMVPSQPVMGQTCGQFMKPFIDEFGGKLHINNTYTVCAYCMYTVGDDFLAQENMSYHHRWRNFGFEWVFVCFNIAAMFVGFYLTYIKKIWPSVIDGIKKCIPSMRRSKTSHNPNEQSV

SEQ ID NO: 110 - protein, 1511 aa, Saccharomyces cerevisiae
MSSTDEHIEKDISSRSNHDDDYANSVQSYAASEGQVDNEDLAATSQLSRHLSNILSNEEGIERLESMARVISHKTKKEMDSFEINDLDFDLRSLLHYLRSRQLEQGIEPGDSGIAFKNLTAVGVDASAAYGPSVEEMFRNIASIPAHLISKFTKKSDVPLRNIIQNCTGVVESGEMLFVVGRPGAGCSTFLKCLSGETSELVDVQGEFSYDGLDQSEMMSKYKGYVIYCPELDFHFPKITVKETIDFALKCKTPRVRIDKMTRKQYVDNIRDMWCTVFGLRHTYATKVGNDFVRGVSGGERKRVSLVEAQAMNASIYSWDNATRGLDASTALEFAQAIRTATNMVNNSAIVAIYQAGENIYELFDKTTVLYNGRQIYFGPADKAVGYFQRMGWVKPNRMTSAEFLTSVTVDFENRTLDIKPGYEDKVPKSSSEFEEYWLNSEDYQELLRTYDDYQSRHPVNETRDRLDVAKKQRLQQGQRENSQYVVNYWTQVYYCMIRGFQRVKGDSTYTKVYLSSFLIKALIIGSMFHKIDDKSQSTTAGAYSRGGMLFYVLLFASVTSLAEIGNSFSSRPVIVKHKSYSMYHLSAESLQEIITEFPTKFVAIVILCLITYWIPFMKYEAGAFFQYILYLLTVQQCTSFIFKFVATMSKSGVDAHAVGGLWVLMLCVYAGFVLPIGEMHHWIRWLHFINPLTYAFESLVSTEFHHREMLCSALVPSGPGYEGISIANQVCDAAGAVKGNLYVSGDSYILHQYHFAYKHAWRNWGVNIVWTFGYIVFNVILSEYLKPVEGGGDLLLYKRGHMPELGTENADARTASREEMMEALNGPNVDLEKVIAEKDVFTWNHLDYTIPYDGATRKLLSDVFGYVKPGKMTALMGESGAGKTTLLNVLAQRINMGVITGDMLVNAKPLPASFNRSCGYVAQADNHMAELSVRESLRFAAELRQQSSVPLEEKYEYVEKIITLLGMQNYAEALVGKTGRGLNVEQRKKLSIGVELVAKPSLLLFLDEPTSGLDSQSAWSIVQFMRALADSGQSILCTIHQPSATLFEQFDRLLLLKKGGKMVYFGDIGPNSETLLKYFERQSGMKCGVSENPAEYILNCIGAGATASVNSDWHDLWLASPECAAARAEVEELHRTLPGRAVNDDPELATRFAASYMTQIKCVLRRTALQFWRSPVYIRAKFFECVACALFVGLSYVGVNHSVGGAIEAFSSIFMLLLIALAMINQLHVFAYDSRELYEVREAASNTFHWSVLLLCHAAVENFWSTLCQFMCFICYYWPAQFSGRASHAGFFFFFYVLIFPLYFVTYGLWILYMSPDVPSASMINSNLFAAMLLFCGILQPREKMPAFWRRLMYNVSPFTYVVQALVTPLVHNKKVVCNPHEYNIMDPPSGKTCGEFLSTYMDNNTGYLVNPTATENCQYCPYTVQDQVVAKYNVKWDHRWRNFGFMWAYICFNIAAMLICYYVVRVKVWSLKSVLNFKKWFNGPRKERHEKDTNIFQTVPGDENKITKK

SEQ ID NO: 111 - protein, 1529 aa, Saccharomyces cerevisiae
MSSDIRDVEERNSRSSSSSSSSNSAAQSIGQHPYRGFDSEAAERVHELARTLTSQSLLYTANSNNSSSSNHNAHNADSRSVFSTDMEGVNPVFTNPDTPGYNPKLDPNSDQFSSTAWVQNMANICTSDPDFYKPYSLGCVWKNLSASGDSADVSYQSTFANIVPKLLTKGLRLLKPSKEEDTFQILKPMDGCLNPGELLVVLGRPGSGCTTLLKSISSNSHGFKIAKDSIVSYNGLSSSDIRKHYRGEVVYNAESDIHLPHLTVYQTLFTVARMKTPQNRIKGVDREAYANHVTEVAMATYGLSHTRDTKVGNDLVRGVSGGERKRVSIAEVAICGARFQCWDNATRGLDSATALEFIRALKTQADIGKTAATVAIYQCSQDAYDLFDKVCVLDDGYQLYFGPAKDAKKYFQDMGYYCPPRQTTADFLTSITSPTERIISKEFIEKGTRVPQTPKDMAEYWLQSESYKNLIKDIDSTLEKNTDEARNIIRDAHHAKQAKRAPPSSPYVVNYGMQVKYLLIRNFWRMKQSASVTLWQVIGNSVMAFILGSMFYKVMKKNDTSTFYFRGAAMFFAILFNAFSCLLEIFSLYETRPITEKHRTYSLYHPSADAFASVLSEMPPKLITAVCFNIIFYFLVDFRRNGGVFFFYFLINVIATFTLSHLFRCVGSLTKTLQEAMVPASMLLLAISMYTGFAIPKTKILGWSIWIWYINPLAYLFESLMINEFHDRRFPCAQYIPAGPAYQNITGTQRVCSAVGAYPGNDYVLGDDFLKESYDYEHKHKWRGFGIGMAYVVFFFFVYLILCEYNEGAKQKGEMVVFLRSKIKQLKKEGKLQEKHRPGDIENNAGSSPDSATTEKKILDDSSEGSDSSSDNAGLGLSKSEAIFHWRDLCYDVPIKGGQRRILNNVDGWVKPGTLTALMGASGAGKTTLLDCLAERVTMGVITGNIFVDGRLRDESFPRSIGYCQQQDLHLKTATVRESLRFSAYLRQPSSVSIEEKNRYVEEVIKILEMQQYSDAVVGVAGEGLNVEQRKRLTIGVELAARPKLLVFLDEPTSGLDSQTAWDTCQLMRKLATHGQAILCTIHQPSAILMQQFDRLLFLQKGGQTVYFGDLGEGCKTMIDYFESKGAHKCPPDANPAEWMLEVVGAAPGSHATQDYNEVWRNSDEYKAVQEELDWMEKNLPGRSKEPTAEEHKPFAASLYYQFKMVTIRLFQQYWRSPDYLWSKFILTIFNQVFIGFTFFKADRSLQGLQNQMLSIFMYTVIFNPILQQYLPSFVQQRDLYEARERPSRTFSWLAFFLSQIIVEIPWNILAGTIAYCIYYYAVGFYANASAAGQLHERGALFWLFSIAFYVYIGSMGLLMISFNEVAETAAHMGTLLFTMALSFCGVMATPKVMPRFWIFMYRVSPLTYMIDALLALGVANVDVKCSNYEMVKFTPPSGTTCGDYMASYIKLAGTGYLSDPSATDICSFCAVSTTNAFLATFSSHYYRRWRNYGIFICYIAFDYIAATFLYWLSRVPKKNGKISEKPKK

SEQ ID NO: 112 - protein, 1333 aa, Saccharomyces cerevisiae
MECVSVEGLDSSFLEGQTFGDILCLPWTIIKGIRERKNRNKMKIILKNVSLLAKSGEMVLVLGRPGAGCTSFLKSAAGETSQFAGGVTTGHISYDGIPQKEMMQHYKPDVIYNGEQDVHFPHLTVKQTLDFAISCKMPAKRVNNVTKEEYITANREFYAKIFGLTHTFDTKVGNDFISGVSGGERKRVSIAEALAAKGSIYCWDNATRGLDSSTALEFARAIRTMTNLLGTTALVTVYQASENIYETFDKVTVLYAGRQIFCGKTTEAKDYFENMGYLCPPRQSTAEYLTAITDPNGLHEIKPGFEYQVPHTADEFEKYWLDSPEYARLKGEIQKYKHEVNTEWTKKTYNESMAQEKSKGTRKKSYYTVSYWEQIRLCTIRGFLRIYGDKSYTVINTCAAIAQAFITGSLFYQAPSSTLGAFSRSGVLFFSLLYYSLMGLANISFEHRPILQKHKVYSLYHPSAEALASTISSFPFRMIGLTFFIIILYFLAGLHRSAGAFFTMYLLLTMCSEAITSLFQMVSSLCDTLSQANSIAGVVMLSIAMYSTYMIQLPSMHPWFKWISYILPIRYAFESMLNAEFHGRHMDCGGTLVPSGPGFENILPENQVCAFVGSRPGQSWVLGDDYLRAQYQYEYKNTWRNFGIMWCFLIGYIVLRAVFTEYKSPVKSGGDALVVKKGTKNAIQRSWSSKNDEENLNASIATQDMKEIASSNDDSTSADFEGLESTGVFIWKNVSFTIPHSSGQRKLLDSVSGYCVPGTLTALIGESGAGKTTLLNTLAQRNVGTITGDMLVDGLPMDASFKRRTGYVQQQDLHVAELTVKESLQFSARMRRPQSIPDAEKMEYVEKIISILEMQEFSEALVGEIGYGLNVEQRKKLSIGVELVGKPDLLLFLDEPTSGLDSQSAWAVVKMLKRLALAGQSILCTIHQPSATLFEQFDRLLLLGKGGQTIYFGEIGKNSSSVIKYFEKNGARKCQQNENPAEYILEAIGAGATASVQQNWPDIWQKSHEYANINEKINDMIKDLSSTTLHKTATRASKYATSYSYQFHHVLKRSSLTFWRNLNYIMAKMMLLMISGLFIGFTFFHVGVNAIGLQNSLFACFMAIVISAPATNQIQERATVAKELYEVRESKSNMFHWSLLLITHYLNELPYHLLFSTIFFVSSYFPLGVFTEASRSSVFYLNYAILFQLYYIGLALMILYMSPNLQSANVIVGFILSFLLSFCGAVQPASLMPGFWTFMWKLSPYTYFLQNLVGLLMHDKPVRCSKKELSLFNPPVGQTCGEFTKPFFEFGTGYIANPDATADCAYCQYKVGDEYLARINASFSYLWRNFGFI

SEQ ID NO: 113 - protein, 1501 aa, Saccharomyces cerevisiae
MSNIKSTQDSSHNAVARSSSASFAASEESFTGITHDKDEQSDTPADKLTKMLTGPARDTASQISATVSEMAPDVVSKVESFADALSRHTTRSGAFNMDSDSDDGFDAHAIFESFVRDADEQGIHIRKAGVTIEDVSAKGVDASALEGATFGNILCLPLTIFKGIKAKRHQKMRQIISNVNALAEAGEMILVLGRPGAGCSSFLKVTAGEIDQFAGGVSGEVAYDGIPQEEMMKRYKADVIYNGELDVHFPYLTVKQTLDFAIACKTPALRVNNVSKKEYIASRRDLYATIFGLRHTYNTKVGNDFVRGVSGGERKRVSIAEALAAKGSIYCWDNATRGLDASTALEYAKAIRIMTNLLKSTAFVTIYQASENIYETFDKVTVLYSGKQIYFGLIHEAKPYFAKMGYLCPPRQATAEFLTALTDPNGFHLIKPGYENKVPRTAEEFETYWLNSPEFAQMKKDIAAYKEKVNTEKTKEVYDESMAQEKSKYTRKKSYYTVSYWEQVKLCTQRGFQRIYGNKSYTVINVCSAIIQSFITGSLFYNTPSSTSGAFSRGGVLYFALLYYSLMGLANISFEHRPILQKHKGYSLYHPSAEAIGSTLASFPFRMIGLTCFFIILFFLSGLHRTAGSFFTIYLFLTMCSEAINGLFEMVSSVCDTLSQANSISGILMMSISMYSTYMIQLPSMHPWFKWISYVLPIRYAFESMLNAEFHGRHMDCANTLVPSGGDYDNLSDDYKVCAFVGSKPGQSYVLGDDYLKNQFQYVYKHTWRNFGILWCFLLGYVVLKVIFTEYKRPVKGGGDALIFKKGSKRFIAHADEESPDNVNDIDAKEQFSSESSGANDEVFDDLEAKGVFIWKDVCFTIPYEGGKRMLLDNVSGYCIPGTMTALMGESGAGKTTLLNTLAQRNVGIITGDMLVNGRPIDASFERRTGYVQQQDIHIAELTVRESLQFSARMRRPQHLPDSEKMDYVEKIIRVLGMEEYAEALVGEVGCGLNVEQRKKLSIGVELVAKPDLLLFLDEPTSGLDSQSSWAIIQLLRKLSKAGQSILCTIHQPSATLFEEFDRLLLLRKGGQTVYFGDIGKNSATILNYFERNGARKCDSSENPAEYILEAIGAGATASVKEDWHEKWLNSVEFEQTKEKVQDLINDLSKQETKSEVGDKPSKYATSYAYQFRYVLIRTSTSFWRSLNYIMSKMMLMLVGGLYIGFTFFNVGKSYVGLQNAMFAAFISIILSAPAMNQIQGRAIASRELFEVRESQSNMFHWSLVLITQYLSELPYHLFFSTIFFVSSYFPLRIFFEASRSAVYFLNYCIMFQLYYVGLGLMILYMSPNLPSANVILGLCLSFMLSFCGVTQPVSLMPGFWTFMWKASPYTYFVQNLVGIMLHKKPVVCKKKELNYFNPPNGSTCGEYMKPFLEKATGYIENPDATSDCAYCIYEVGDNYLTHISSKYSYLWRNFGIFWIYIFFNIIAMVCVYYLFHVRQSSFLSPVSILNKIKNIRKKKQ

SEQ ID NO: 114 - protein, 1290 aa, Saccharomyces cerevisiae
MNFLSFKTTKHYHIFRYVNIRNDYRLLMIMIIGTVATGLVPAITSILTGRVFDLLSVFVANGSHQGLYSQLVQRSMAVMALGAASVPVMWLSLTSWMHIGERQGFRIRSQILEAYLEEKPMEWYDNNEKLLGDFTQINRCVEELRSSSAEASAITFQNLVAICALLGTSFYYSWSLTLIILCSSPIITFFAVVFSRMIHVYSEKENSETSKAAQLLTWSMNAAQLVRLYCTQRLERKKFKEIILNCNTFFIKSCFFVAANAGILRFLTLTMFVQGFWFGSAMIKKGKLNINDVITCFHSCIMLGSTLNNTLHQIVVLQKGGVAMEKIMTLLKDGSKRNPLNKTVAHQFPLDYATSDLTFANVSFSYPSRPSEAVLKNVSLNFSAGQFTFIVGKSGSGKSTLSNLLLRFYDGYNGSISINGHNIQTIDQKLLIENITVVEQRCTLFNDTLRKNILLGSTDSVRNADCSTNENRHLIKDACQMALLDRFILDLPDGLETLIGTGGVTLSGGQQQRVAIARAFIRDTPILFLDEAVSALDIVHRNLLMKAIRHWRKGKTTIILTHELSQIESDDYLYLMKEGEVVESGTQSELLADPTTTFSTWYHLQNDYSDAKTIVDTETEEKSIHTVESFNSQLETPKLGSCLSNLGYDETDQLSFYEAIYQKRSNVRTRRVKVEEENIGYALKQQKNTESSTGPQLLSIIQIIKRMIKSIRYKKILILGLLCSLIAGATNPVFSYTFSFLLEGIVPSTDGKTGSSHYLAKWSLLVLGVAAADGIFNFAKGFLLDCCSEYWVMDLRNEVMEKLTRKNMDWFSGENNKASEISALVLNDLRDLRSLVSEFLSAMTSFVTVSTIGLIWALVSGWKLSLVCISMFPLIIIFSAIYGGILQKCETDYKTSVAQLENCLYQIVTNIKTIKCLQAEFHFQLTYHDLKIKMQQIASKRAIATGFGISMTNMIVMCIQAIIYYYGLKLVMIHEYTSKEMFTTFTLLLFTIMSCTSLVSQIPDISRGQRAASWIYRILDEKHNTLEVENNNARTVGIAGHTYHGKEKKPIVSIQNLTFAYPSAPTAFVYKNMNFDMFCGQTLGIIGESGTGKSTLVLLLTKLYNCEVGKIKIDGTDVNDWNLTSLRKEISVVEQKPLLFNGTIRDNLTYGLQDEILEIEMYDALKYVGIHDFVISSPQGLDTRIDTTLLSGGQAQRLCIARALLRKSKILILDECTSALDSVSSSIINEIVKKGPPALLTMVITHSEQMMRSCNSIAVLKDGKVVERGNFDTLYNNRGELFQIVSNQSS

SEQ ID NO: 115 - protein, 1477 aa, Saccharomyces cerevisiae
MTITVGDAVSETELENKSQNVVLSPKASASSDISTDVDKDTSSSWDDKSLLPTGEYIVDRNKPQTYLNSDDIEKVTESDIFPQKRLFSFLHSKKIPEVPQTDDERKIYPLFHTNIISNMFFWWVLPILRVGYKRTIQPNDLFKMDPRMSIETLYDDFEKNMIYYFEKTRKKYRKRHPEATEEEVMENAKLPKHTVLRALLFTFKKQYFMSIVFAILANCTSGFNPMITKRLIEFVEEKAIFHSMHVNKGIGYAIGACLMMFVNGLTFNHFFHTSQLTGVQAKSILTKAAMKKMFNASNYARHCFPNGKVTSFVTTDLARIEFALSFQPFLAGFPAILAICIVLLIVNLGPIALVGIGIFFGGFFISLFAFKLILGFRIAANIFTDARVTMMREVLNNIKMIKYYTWEDAYEKNIQDIRTKEISKVRKMQLSRNFLIAMAMSLPSIASLVTFLAMYKVNKGGRQPGNIFASLSLFQVLSLQMFFLPIAIGTGIDMIIGLGRLQSLLEAPEDDPNQMIEMKPSPGFDPKLALKMTHCSFEWEDYELNDAIEEAKGEAKDEGKKNKKKRKDTWGKPSASTNKAKRLDNMLKDRDGPEDLEKTSFRGFKDLNFDIKKGEFIMITGPIGTGKSSLLNAMAGSMRKTDGKVEVNGDLLMCGYPWIQNASVRDNIIFGSPFNKEKYDEVVRVCSLKADLDILPAGDMTEIGERGITLSGGQKARINLARSVYKKKDIYLFDDVLSAVDSRVGKHIMDECLTGMLANKTRILATHQLSLIERASRVIVLGTDGQVDIGTVDELKARNQTLINLLQFSSQNSEKEDEEQEAVVAGELGQLKYESEVKELTELKKKATEMSQTANSGKIVADGHTSSKEERAVNSISLKIYREYIKAAVGKWGFIALPLYAILVVGTTFCSLFSSVWLSYWTENKFKNRPPSFYMGLYSFFVFAAFIFMNGQFTILCAMGIMASKWLNLRAVKRILHTPMSYIDTTPLGRILNRFTKDTDSLDNELTESLRLMTSQFANIVGVCVMCIVYLPWFAIAIPFLLVIFVLIADHYQSSGREIKRLEAVQRSFVYNNLNEVLGGMDTIKAYRSQERFLAKSDFLINKMNEAGYLVVVLQRWVGIFLDMVAIAFALIITLLCVTRAFPISAASVGVLLTYVLQLPGLLNTILRAMTQTENDMNSAERLVTYATELPLEASYRKPEMTPPESWPSMGEIIFENVDFAYRPGLPIVLKNLNLNIKSGEKIGICGRTGAGKSTIMSALYRLNELTAGKILIDNVDISQLGLFDLRRKLAIIPQDPVLFRGTIRKNLDPFNERTDDELWDALVRGGAIAKDDLPEVKLQKPDENGTHGKMHKFHLDQAVEEEGSNFSLGERQLLALTRALVRQSKILILDEATSSVDYETDGKIQTRIVEEFGDCTILCIAHRLKTIVNYDRILVLEKGEVAEFDTPWTLFSQEDSIFRSMCSRSGIVENDFENRS

SEQ ID NO: 116 - protein, 1394 aa, Saccharomyces cerevisiae
MSISKYFTPVADGSLTFNGANIQFGADAQGESKKSYDAEDSMPNPANQLNDITFQAEAGEMVLVLGYPTSTLFKTLFHGKTSLSYSPPGSIKFKNNEFKSFSEKCPHQIIYNNEQDVHFPFLTVEQTIDFALSCKFDIPKGERDQIRNELLREFGLSHVLKTIVGNDFFRGVSGGERKRISIIETFIANGSVYLWDNSTKGLDSATALDFLEILRKMAKATRSVNLVRISQASDKIVDKFDKILMLSDSYQLFYGTVDECLTYFRDTLGIEKDPNDCIIEYLTSILNFQFKNKNLGNLSNSSSASVLKTATGEVTKYTYNSDFDLYDQWKHSSYYRNIKQQIQGSSIDDSIKEVDPSDVSPIFNIPLKKQLLFCTKRAFQRSLGDKAYMTAQFISVVIQSLVIGSLFYEIPLTTIGSYSRGSLTFFSILFFTFLSLADMPIAFQRQPVVKKQSQLHFYTNWVETLSTTVFDYCFKLCLVIVFSIILYFLAHLQYKAARFFIFLLFLSFYNFCMVSLFALTTLVAPTISVANLFAGILLLAIAMYASYVIYLKNMHPWFVWIAYLNPAMYAMEAILSNELYNLKLDCSETIVPRGPTYNDVPFSHKACAWQGATLGNDYVRGRDYLKQGLSYTYHHVWRNFGIIIGFLVFFIACTLFASQYIKPYFNKDEIERNNSRLTRWLPFLNKKRGTRSSARNDSKYVGIPKSHSVSSSSSSLSAVPYQISPSNKEMALNDYNEQPITETVETQKHIISWKNINYTVGTKKLINNASGFISSGLTALMGESGAGKTTLLNVLSQRVETGVVSGEILIDGHPLTDEDAFKRSIGFVQQQDLHLDLLSVKESLEISCLLRGDGDRAYLDTVSNLLKLPSDILVADLNPTQRKLLSIGVELVTKPSLLLFLDEPTSGLDAEAALTIVKFLKQLSLQGQAIFCTIHQPSKSVISHFDNIFLLKRGGECVFFGPMDDACGYFMSHDNTLVYDKEHDNPADFVIDAVGNSNSSAGKDTAEEALTLNKEAIDWSALWESSVEKKLVKKETARLEDDARASGVDYTTSLWKQPSYLQQLALITRRQYICTKRDMTYVMAKYCLNGGAGLFIGFSFWHIKHNIIGLQDSIFFCFMALCVSSPLINQIQDKALKTKEVYVAREARSNTYHWTVLLLSQSIIELPLALTSSTLFFVCAFFSCGFNNAGWSAGVFFLNYMLFAAYYSTLGLWLIYTAPNLQTAAVFVAFIYSFTASFCGVMQPYSLFPTFWKFMYRVSPYTYFVETFVSILLHNWEIKCDMSEMVPGQPLTGQSCGQFMEAFIEEYGGYLHNKNTFTVCAYCTYTVGDDFLKNENMSYDHVWRNFGIEWAFVGFNFFAMFAGYYLTYVARIWPKVFKIITKVIPHRGKKPVQN

SEQ ID NO: 117 - protein, 1294 aa, Saccharomyces cerevisiae
MSQQENGDVATELIENRLSFSRIPRISLHVRDLSIVASKTNTTLVNTFSMDLPSGSVMAVMGGSGSGKTTLLNVLASKISGGLTHNGSIRYVLEDTGSEPNETEPKRAHLDGQDHPIQKHVIMAYLPQQDVLSPRLTCRETLKFAADLKLNSSERTKKLMVEQLIEELGLKDCADTLVGDNSHRGLSGGEKRRLSIGTQMISNPSIMFLDEPTTGLDAYSAFLVIKTLKKLAKEDGRTFIMSIHQPRSDILFLLDQVCILSKGNVVYCDKMDNTIPYFESIGYHVPQLVNPADYFIDLSSVDSRSDKEEAATQSRLNSLIDHWHDYERTHLQLQAESYISNATEIQIQNMTTRLPFWKQVTVLTRRNFKLNFSDYVTLISTFAEPLIIGTVCGWIYYKPDKSSIGGLRTTTACLYASTILQCYLYLLFDTYRLCEQDIALYDRERAEGSVTPLAFIVARKISLFLSDDFAMTMIFVSITYFMFGLEADARKFFYQFAVVFLCQLSCSGLSMLSVAVSRDFSKASLVGNMTFTVLSMGCGFFVNAKVMPVYVRWIKYIAFTWYSFGTLMSSTFTNSYCTTDNLDECLGNQILEVYGFPRNWITVPAVVLLCWSVGYFVVGAIILYLHKIDITLQNEVKSKQKKIKKKSPTGMKPEIQLLDDVYHQKDLEAEKGKNIHITIKLEDIDLRVIFSAPFSNWKEGNFHHETKEILQSVNAIFKPGMINAIMGPSGSGKSSLLNLISGRLKSSVFAKFDTSGSIMFNDIQVSELMFKNVCSYVSQDDDHLLAALTVKETLKYAAALRLHHLTEAERMERTDNLIRSLGLKHCENNIIGNEFVKGISGGEKRRVTMGVQLLNDPPILLLDEPTSGLDSFTSATILEILEKLCREQGKTIIITIHQPRSELFKRFGNVLLLAKSGRTAFNGSPDEMIAYFTELGYNCPSFTNVADFFLDLISVNTQNEQNEISSRARVEKILSAWKANMDNESLSPTPISEKQQYSQESFFTEYSEFVRKPANLVLAYIVNVKRQFTTTRRSFDSLMARIAQIPGLGVIFALFFAPVKHNYTSISNRLGLAQESTALYFVGMLGNLACYPTERDYFYEEYNDNVYGIAPFFLAYMTLELPLSALASVLYAVFTVLACGLPRTAGNFFATVYCSFIVTCCGEALGIMTNTFFERPGFVVNCISIILSIGTQMSGLMSLGMSRVLKGFNYLNPVGYTSMIIINFAFPGNLKLTCEDGGKNSDGTCEFANGHDVLVSYGLVRNTQKYLGIIVCVAIIYRLIAFFILKAKLEWIKW

SEQ ID NO: 118 - protein, 542 aa, Saccharomyces cerevisiae
MSVQKEEYDIVEKAQLSVSAESLTSDSESISHNPFDDFHKAERWRKVYESSGYEGLSKFDPEFTWTKDEEKKLVRKMDLKIFLWVFIMFAFLDLIRKNIARAVSDNFIVDLKMNTNDYNLGQTVYLVIFLASELPGNLLSKRFGPERVIPVQIVLWSVICITQAGLKNRGQFIATRCLLGMVQGGFIPDNILYLSYYYTGAELTFRLSFFWCAIPLFQILGSLLASGIIEMRGIHNLAGWQYLFIIEGFLSLSVGVASFYLMRRGPTQTGESAFHKGKSLFTEYEEKIMVNRILRDDPSKGDMSNRQPVTFKEILYTLTEFDLWPLFIQGITAFISLQTVGSYLSLILKSLNYSTFLSNILAIPGQALLLINLPLAALLSRKLKEKSLCVGIANVWVLPFIVSLVALPTDTNPWIKYILLTGILGLPYTHSILAGWVSEISNSVRSRTVGTALYNMSAQVGAIIASNMYRNDDKPYYTRGNKILLGFTCFNICMAVATKFYYISRNKYKDRKWNSMTKEEQINYLDTTKDKGMKRLDYRFIH

SEQ ID NO: 119 - protein, 523 aa, Saccharomyces cerevisiae
MKNMSQRSMDVEKKAANADSCSVSTSSINVDDADVALRFLKQNGLDESSTANEDDVVAGEEANFYGSHELSPKVLRKVDLFILPFLCCTYLLMFLDKALLNYAASMGIKDHLKGNEFSNLGTIFSAAYIFMEPVVTYLIQKFPISKILGTFITVWGIVLACHAACKTYASLMVVRTLLGLFESSSAVGCIAISGMYYTKSEQSARIGFWATQAGTGYIVGGLISFGFLHYHGTAFTSWQIMFLVVGLVTVAFGVLTFLYLPDNVTNAWFLNKEEKIQVVEHIRANQTGLETKKFKKQQVKELFLHDKFTWPMLLLTACSQISTGAIGTFSVTITGTFGFDKYETALLQLPIGAITAMIILITTQMLSRWGHITLITTSMYIPAIIGCIVLISLPLSHKIGNLFSLYLLYSGSCVITNIYIWNSCNTSGYTKRVFRNAITMIVYNVSCIIAPQMFRAYSAPRYIPAKIALLVTQCVCVPLQLYIGYICKKENEKRDKEQEGQERKKYQFLDLTDIENRNFRYIY

SEQ ID NO: 120 - protein, 1218 aa, Saccharomyces cerevisiae
MIKNGTCPYWERDDLSECARREYIEFKFPLFILLTGMIYAFCKVFRAFYLRGKNHTNEAPEFEEQGNGNHEYARFSVLRLKSAWESRSFCNVNNRSTFDKFKKFIEGAFIVLQLTIHLYILSSMPMDNKKFFHQGFLVQMFLWILLLVVITLRLISASQSFRWVLACKRDLWAVSFYSYASLFTLSILPLRSVFIGKIKDKIMVKYIISETFIDLALLLLLSTSSIEGTRYSFLVENENKKLPPAPTVFGLLTFSRIDRLIWKAYKHCLGNADIWDLDINNKSIAILANFEMSSKKGRLLPNIICYFKAVFISQLFLAFVSSFLNFVPSLLMPRILSYVNDPKSKSWNLVSLYVSSMLVSKIIATTCRGQGLFLGEKGTMQLRTVLISNIYSKTLRRTILKDSTTSLQKNASTSFEENPDSSEAEPRKKSSRKDNSVNNVMSIDAFKVSEAMNTFYLACEAVFMTVTALMILYSLLGWSAFAGTFALLAMIPLNFWCATFYGNYQADQLILTDKRTSGISEALNSIRVIKLLAWENLFYQKIINVRDGEIRLLKKKATIFFLNHLIWFFGPTLVSAITFSVFIKFQNQTLTPTIAFTALSLFAILRTPMDQIASTVSLLIQSFISLERIQDYLNESETRKYEILEQSNTKFGFEDASMEWEAAETSFKLKNISIDFKLNSLNAIIGPTGSGKSSLLLGLLGELNLLSGKIYVPTVESRDDLEIGKDGMTNSMAYCSQTPWLISGTIKDNVVFGEIFNKQKFDDVMKSCCLDKDIKAMTAGIRTDVGDGGFSLSGGQQQRIALARAIYSSSRYLILDDCLSAVDPETALYIYEECLCGPMMKGRTCIITSHNISLVTKRADWLVILDRGEVKSQGKPSDLIKSNEFLRESINNDSKNTTHNQIDLKRSTTSKKTKNGDPEGGNSQDEVCAEVENFEETKMEGSVKFSAYKWLADYFGGLGVVFVFTSSSILIHGITLSQGFWLRYWLDTGSSGSKSTWLYRIVEGHSNIYFLLTYIIIGLVSSFLTSGKVWIAIISGTNVTKKIFAKLLSSILYAKLRFHNVTPTGRIMNRFSKDMDIIDQQLIPNFEGLSYSVVVCLWIILLIGYVTPQFLLFAIPLCALYYTVCTLYLRASRELKRIDNINISPIHQLFAEAIKGVTTIRALADERRFITQSLVAIDRSNAPFFYLNMATEWITYRVDIIGTLVLFSSSVMIIMKAS

SEQ ID NO: 121 - protein, 1049 aa, Saccharomyces cerevisiae
MGSHRRYLYYSILSFLLLSCSVVLAKQDKTPFFEGTSSKNSRLTAQDKGNDTCPPCFNCMLPIFECKQFSECNSYTGRCECIEGFAGDDCSLPLCGGLSPDESGNKDRPIRAQNDTCHCDNGWGGINCDVCQEDFVCDAFMPDPSIKGTCYKNGMIVDKVFSGCNVTNEKILQILNGKIPQITFACDKPNQECNFQFWIDQLESFYCGLSDCAFEYDLEQNTSHYKCNDVQCKCVPDTVLCGAKGSIDISDFLTETIKGPGDFSCDLETRQCKFSEPSMNDLILTVFGDPYITLKCESGECVHYSEIPGYKSPSKDPTVSWQGKLVLALTAVMVLALFTFATFYISKSPLFRNGLGSSKSPIRLPDEDAVNNFLQNEDDTLATLSFENITYSVPSINSDGVEETVLNEISGIVKPGQILAIMGGSGAGKTTLLDILAMKRKTGHVSGSIKVNGISMDRKSFSKIIGFVDQDDFLLPTLTVFETVLNSALLRLPKALSFEAKKARVYKVLEELRIIDIKDRIIGNEFDRGISGGEKRRVSIACELVTSPLVLFLDEPTSGLDASNANNVIECLVRLSSDYNRTLVLSIHQPRSNIFYLFDKLVLLSKGEMVYSGNAKKVSEFLRNEGYICPDNYNIADYLIDITFEAGPQGKRRRIRNISDLEAGTDTNDIDNTIHQTTFTSSDGTTQREWAHLAAHRDEIRSLLRDEEDVEGTDGRRGATEIDLNTKLLHDKYKDSVYYAELSQEIEEVLSEGDEESNVLNGDLPTGQQSAGFLQQLSILNSRSFKNMYRNPKLLLGNYLLTILLSLFLGTLYYNVSNDISGFQNRMGLFFFILTYFGFVTFTGLSSFALERIIFIKERSNNYYSPLAYYISKIMSEVVPLRVVPPILLSLIVYPMTGLNMKDNAFFKCIGILILFNLGISLEILTIGIIFEDLNNSIILSVLVLLGSLLFSGLFINTKNITNVAFKYLKNFSVFYYAYESLLINEVKTLMLKERKYGLNIEVPGATILSTFGFVVQNLVFDIKILALFNVVFLIMGYLALKWIVVEQK

SEQ ID NO: 122 - protein, 548 aa, Saccharomyces cerevisiae
MVYTSTYRHTIVVDLLEYLGIVSNLETLQSAREDETRKPENTDKKECKPDYDIECGPNRSCSESSTDSDSSGSQIEKNDPFRVDWNGPSDPENPQNWPLLKKSLVVFQIMLLTCVTYMGSSIYTPGQEYIQEEFHVGHVVATLNLSLYVLGYGLGPIIFSPLSETARYGRLNLYMVTLFFFMIFQVGCATVHNIGGLIVMRFISGILCSPSLATGGGTVADIISPEMVPLVLGMWSAGAVAAPVLAPLLGAAMVDAKNWRFIFWLLMWLSAATFILLAFFFPETQHHNILYRRALKLRKETGDDRYYTEQDKLDREVDARTFLINTLYRPLKMIIKEPAILAFDLYIAVAYGCFYLFFEAFPIVFVGIYHFSLVEVGLAYMGFCVGCVLAYGLFGILNMRIIVPRFRNGTFTPEAFLIVAMCVCWCLPLSLFLFGWTARVHWILPVISEVFFVLAVFNIFQATFAYLATCYPKYVASVFAGNGFCRASFACAFPLFGRAMYDNLATKNYPVAWGSSLVGFLTLGLAIIPFILYKYGPSLRTRSSYTEE

SEQ ID NO: 123 - protein, 563 aa, Saccharomyces cerevisiae
MTKQQTSVMRNASIAKEEREGSDNNNVDRSSSDAISDNDAERSNSHSEIDNESNFDMVPYSRFSHKQKMLLVVQCAFTGFFSTVAGSIYYPVLTIIERKFNITEELANVTIVVYFIFQGVAPSIMGGLADTFGRRPIVLWAILAYFCACIGLACAHNYAQILALRCLQAAGISPVIAINSGIMGDVTTKVERGGYVGLVAGFQVVGTAFGALIGAGLSSKWGWRAIFWFLAIGSGICLVFSTLLMPETKRTLVGNGSVTPRSFLNRSLILHVGSVKKTLHLDDPDPETLEPRTSVDFLAPLKILHIREIDILLSIAGLQFSTWTTHQTALTIVLSKKYNLSVAKIGLCFLPAGISTLTSIISAGRYLNWSYRTRKVKYNRWIKEQELQLMEKYKGDKNKVAELIHSNSHYAFNLVEARLHPAFVTLLLSSIGFTAFGWCISVKTPLAAVLCTSAFASLFSNCILTFSTTLIVDLFPSKASTATGCLNLFRCLLSAIFIAALTKMVEKMRYGGVFTFLSAITSSSSLLLFYLLKNGKQLSFDRIRANDKSAGRSVGKNSEKVST

SEQ ID NO: 124 - protein, 542 aa, Saccharomyces cerevisiae
MAGATSSIIRENDFEDELAESMQSYNRETADKLALTRTESVKPEPEITAPPHSRFSRSFKTVLIAQCAFTGFFSTIAGAIYYPVLSVIERKFDIDEELVNVTVVVYFVFQGLAPTFMGGFADSLGRRPVVLVAIVIYFGACIGLACAQTYAQIIVLRCLQAAGISPVIAINSGIMGDVTTRAERGGYVGYVAGFQVLGSAFGALIGAGLSSRWGWRAIFWFLAIGSGICFLASFLILPETKRNISGNGSVTPKSYLNRAPILVLPTVRKSLHLDNPDYETLELPTQLNLLAPFKILKAYEICILMLVAGLQFAMYTTHLTALSTALSKQYHLTVAKVGLCYLPSGICTLCSIVIAGRYLNWNYRRRLKYYQNWLGKKRSKLLEEHDNDLNLVQRIIENDPKYTFNIFKARLQPAFVTLLLSSSGFCAYGWCITVKAPLAAVLCMSGFASLFSNCILTFSTTLIVDLFPTKTSTATGCLNLFRCILSAVFIAALSKMVEKMKFGGVFTFLGALTSSSSILLFILLRKGKELAFKRKKQELGVN

SEQ ID NO: 125 - protein, 689 aa, Saccharomyces cerevisiae
MQAQGSQSNVGSLRSNCSDNSLPNNHVMMHCDESSGSPHSEHNDYSYEKTNLESTASNSREHRDNQLSRLKSEEYVVPKNQRRGLLPQLAIIPEFKDARDYPPMMKKMIVFLIAFSSMMGPMGTSIIFPAINSITTEFKTSVIMVNVSIGVYLLSLGVFPLWWSSLSELEGRRTTYITSFALLFAFNIGSALAPDINSFIALRMLCGAASASVQSVGAGTVADLYISEDRGKNLSYYYLGPLLAPLLSPIFGSLLVNRWPWRSTQWFMVILSGCNVILLTVLLPETLRKQDSKGAIAQILAERRIQVDNNERGEIQEDYQRGEDETDRIENQVATLSTEKHNYVGEVRDQDSLDLESHSSPNTYDGRAGETQLQRIYTEASRSLYEYQLDDSGIDATTAQVTRIRSTDPKLARSIRENSLRKLQTNLEEQVKKVLSSNGGEIAPKQVSAVRKVWDTFFVYFIKPLKSLHFLEYPPVALAITFSAISFSTVYFVNMTVEYKYSRPPYNFKPLYIGLLYIPNSVTYFFASIYGGRWVDMLLKRYKEKYGILAPEARISWNVVTSVISFPIALLIFGWCLDKKCHWVTPLIGTALFGYAAMMTIGATLSYLVDSLPGKGATGVALNNLIRQILAATAVFVTTPMLNGMGTGWAFTMLAFIVLGASSVLIILKKHGDYWRENYDLQKLYDKID

SEQ ID NO: 126 - protein, 586 aa, Saccharomyces cerevisiae
MSDHSPISNKENHLLPSDSSRSSSSDMHSTGTTGTTGVEPVDFTGEGAKYTTATEGNGGADLAIQRTTTMNSAAESEVNITRRLTKILTGSVNEPDRVEVDYTNCAPMGGDRPYPPSLPSRDLYEVTFDGPNDPLHPFNWPMKKKVLLCLVLCLDSIAIAMCSSIFASAVPQICEIYHVIEVVAILGITLFVLGFAASPVIYAPLSELYGRKGVLVLSAFGFALFQFAVATAENLQTIFICRFFGGFIGAAPMAVVPAAFADMFDTNVRGKAIALFSLGVFVGPILSPVMGSYIAQRTTWRWLEYVVGCFASAVFVAIVLFFEETHHPTILVNKAKQMRKQSNNWGIHAAHEDVELSIKDIVQKTVTRPIIMLFVEPLLLFVTIYNSFVYGILYLLLEAYPLVFVEGYGFTENGELPYIALIIGMMVCAAFIWYMDNDYLKRCRAKGKLVPEARLYAMVIAGTVFPIGILWFCWTGYYPHKIHWMVPTVGGAFIGFGLMGIFLPCLNYIIESYLLLAASAVAANTFMRSAFGACFPLFAGYMFRGMGIGWAGLLLGLFAAAMIPVPLLFLKYGESIRKKSKYAYAA

SEQ ID NO: 127 - protein, 614 aa, Saccharomyces cerevisiae
MSDQESVVSFNSQNTSMVDVEGQQPQQYVPSKTNSRANQLKLTKTETVKSLQDLGVTSAAPVPDINAPQTAKNNIFPEEYTMETPSGLVPVATLQSMGRTASALSRTRTKQLNRTATNSSSTGKEEMEEEETEEREDQSGENELDPEIEFVTFVTGDPENPHNWPSWVRWSYTVLLSILVICVAYGSACISGGLGTVEKKYHVGMEAAILSCSLMVIGFSLGPLIWSPVSDLYGRRVAYFVSMGLYVIFNIPCALAPNLGCLLACRFLCGVWSSSGLCLVGGSIADMFPSETRGKAIAFFAFAPYVGPVVGPLVNGFISVSTGRMDLIFWVNMAFAGVMWIISSAIPETYAPVILKRKAARLRKETGNPKIMTEQEAQGVSMSEMMRACLLRPLYFAVTEPVLVATCFYVCLIYSLLYAFFFAFPVIFGELYGYKDNLVGLMFIPIVIGALWALATTFYCENKYLQIVKQRKPTPEDRLLGAKIGAPFAAIALWILGATAYKHIIWVGPASAGLAFGFGMVLIYYSLNNYIIDCYVQYASSALATKVFLRSAGGAAFPLFTIQMYHKLNLHWGSWLLAFISTAMIALPFAFSYWGKGLRHKLSKKDYSIDSVEM

SEQ ID NO: 128 - protein, 622 aa, Saccharomyces cerevisiae
MNRQESINSFNSDETSSLSDVESQQPQQYIPSESGSKSNMAPNQLKLTRTETVKSLQDMGVSSKAPVPDVNAPQSSKNKIFPEEYTLETPTGLVPVATLHSIGRTSTAISRTRTRQIDGASSPSSNEDALESDNNEKGKEGDSSGANDEAPDLDPEIEFVTFVTGDPENPHNWPAWIRWSYTVLLSILVICVAYGSACISGGLGTVEKKYHVGMEAAILSVSLMVIGFSLGPLIWSPVSDLYGRRVAYFVSMGLYVIFNIPCALAPNLGSLLACRFLCGVWSSSGLCLVGGSIADMFPSETRGKAIAFFAFAPYVGPVVGPLVNGFISVSTGRMDLIFWVNMAFAGVMWIISSAIPETYAPVILKRKAARLRKETGNPKIMTEQEAQGVSMGEMMRACLLRPLYFSVTEPVLVATCFYVCLIYSLLYAFFFAFPVIFGELYGYKDNLVGLMFIPIVIGALWALATTFYCENKYLQIVKQRKPTPEDRLLGAKIGAPFAAIALWILGATAYKHIIWVGPASAGLAFGFGMVLIYYSLNNYIIDCYVQYASSALATKVFLRSAGGAAFPLFTIQMYHKLNLHWGSWLLAFISTAMIALPFAFSYWGKGLRHKLSKKDYSIDSIE

SEQ ID NO: 129 - protein, 659 aa, Saccharomyces cerevisiae
MPSSLTKTESNSDPRTNIQQVPKALDKNVTNSGNLDSTSSSTGSITEDEKRSEPNADSNNMTGGEPIDPRDLDWDGPDDPDNPHNWSSLKKWYTTMTSAFLCLVVTMGSSLYVSSVPELVERYHVSQTLALAGLTFYLLGLSTVIGAPLSEVFGRKPVYLFSLPVSMLFTMGVGLSNGHMRIILPLRFLSGVFASPALSVGSGTILDIFDVDQVSVAMTYFVLSPFLGPVLSPIMAGFATEAKGWRWSEWIQLIAGGLILPFIALMPETHKGIILRKRAKKRNIALKKFSREAQKEFLKTTVTITILRPLKMLVVEPIVFVFSVYVAFIFAILFGFFEAYAVIYRGVYHMSMGISGLPFIGIGVGLWIGAFFYLYIDRKYLFPKPPAGTQPLTEKERTSKRTTPYRGARDAETGELLPVVPEKFLIACKFGSVALPIGLFWQAWTARSDVHWMAPVAAGVPFGFGLILIFFSVLMYFSTCYPPLTVASCLAANNLLRYVMSSVFPLFTIQMYTKMKIKWASTLFALVCVVMIPIPWVFEKWGSKLRHKSQFGYAAMEKEAETEGGIDDVNAVDGELNLTRMTTLRTMETDPSTREKPGERLSLRRTHTQPVPASFDREDGQHAQNRNEPISNSLYSAIKDNEDGYSYTEMATDASARMV

SEQ ID NO: 130 - protein, 586 aa, Saccharomyces cerevisiae
MSRSNSIYTEDIEMYPTHNEQHLTREYTKPDGQTKSEKLNFEGAYINSHGTLSKTTTREIEGDLDSETSSHSSDDKVDPTQQITAETKAPYTLLSYGQKWGMVAILTMCGFWSSLGSPIYYPALRQLEKQFNVDENMVNVTVVVYLLFQGISPTVSGGLADCFGRRPIILAGMLIYVIASIGLACAPSYGVIIFLRCIQSIGISPTIAISSGVVGDFTLKHERGTFVGATSGFVLLGQCFGSLIGAVLTARWDWRAIFWFLTIGCGSCFLIAFLILPETKRTIAGNLSIKPKRFINRAPIFLLGPVRRRFKYDNPDYETLDPTIPKLDLSSAGKILVLPEIILSLFPSGLLFAMWTLMLSSISSGLSVAPYNYHLVIIGVCYLPGGIGGLMGSFFTGRIIDMYFKRKIKKFEQDKANGLIPQDAEINMFKVRLVCLLPQNFLAVVAYLLFGWSIDKGWRIESILITSFVCSYCAMSTLSTSTTLLVDLYPTKSSTASSCFNFVRCSLSTIFMGCFAKMKAAMTVGGTFTFLCALVFFFNFLMFIPMKYGMKWREDRLLKQQRQSWLNTLAVKAKKGTKRDQNDNHN

SEQ ID NO: 131 - protein, 613 aa, Saccharomyces cerevisiae
MKGEPKTYSMSDLSYYGEKAQQQNEKQQKQYVVRRNSTQSTSKQNVSVVLEDNASESNELPKGFILYASLIALALSLFLAALDIMIVSTIIEEVAKQFGSYSEIGWLFTGYSLPNALLALIWGRIATPIGFKETMLFAIVIFEIGSLISALANSMSMLIGGRVIAGVGGCGIQSLSFVIGSTLVEESQRGILIAVLSCSFAIASVVGPFLGGVFTSSVTWRWCFYVNLPIGGLAFFLFLFFYNPGLSTFQETMDNIRKFPSQFIEIVRNVAYHLLKIKGFSKLNGWRKPFMELIFMYDIIEFVFCSAGFTCILLAFTFGGNRYAWNSASIIILFIIGIVLVVLAGIYDFLVFPKFNIVKATPHYQPLMSWTNIKKPGIFTVNIALFLTCAGYISQFTYIVQYFQLIYNDSAWRAAVHLVACIISTVVTAILCGAITDKTRQIKPIIVISSIFGVVGAGILTLLNNNANNSAHIGLLILPGVAFGGLAQSSMLASQIQLDKKSPTFRSDFVSITTFNTFCKNLGQALGGVISNTVFSAAAIKKLTKANIQLPDGTTVDNLVIYRQTNFDGSHSKLGNIISESLTDVFYMALGFYALSLIFAVFASNKKVTASLR

SEQ ID NO: 132 - protein, 543 aa, Saccharomyces cerevisiae
MKSTLSLTLCVISLLLTLFLAALDIVIVVTLYDTIGIKFHDFGNIGWLVTGYALSNAVFMLLWGRLAEILGTKECLMISVIVFEIGSLISALSNSMATLISGRVVAGFGGSGIESLAFVVGTSIVRENHRGIMITALAISYVIAEGVGPFIGGAFNEHLSWRWCFYINLPIGAFAFIILAFCNTSGEPHQKMWLPSKIKKIMNYDYGELLKASFWKNTFEVLVFKLDMVGIILSSAGFTLLMLGLSFGGNNFPWNSGIIICFFTVGPILLLLFCAYDFHFLSLSGLHYDNKRIKPLLTWNIASNCGIFTSSITGFLSCFAYELQSAYLVQLYQLVFKKKPTLASIHLWELSIPAMIATMAIAYLNSKYGIIKPAIVFGVLCGIVGSGLFTLINGELSQSIGYSILPGIAFGSIFQATLLSSQVQITSDDPDFQNKFIEVTAFNSFAKSLGFAFGGNMGAMIFTASLKNQMRSSQLNIPQFTSVETLLAYSTEHYDGPQSSLSKFINTAIHDVFYCALGCYALSFFFGIFTSSKKTTISAKKQQ

SEQ ID NO: 133 - protein, 514 aa, Saccharomyces cerevisiae
MVAEFQIASAQSSALTSTEEEHCSINSDKAAKLDLELTSERKNDGKQSHEVTFNEDIADPEDIARHMSTARRYYISSLITFTSMVITMISSSWTLPSTHIIEHFHISHEVSTLGITLYVFGLGIGPLFLSPLSELYGRRITFLYALTLSIIWQCLTIWSKTITGVMFGRFLSGFFGSAFLSVAGGAIADIFDKDQIGIPMAIYTTSAFLGPSLGPIIGGALYHQSYKWTFITLLITSGCCLVMIIFTIPETYKPMLLIRKAKRLRKEKNDQRYYAVLEVTREQTSLLSAIFLSTKRPFGLLLRDRMMGVLCFYTGLELAIIYLYFVAFPYVFKKLYNFGPMEIACSYIGIMVGMILSAPTCLLFQKTFEWRVKRNNGVKTPEMRFEPLFYGAFLTPVGLFIFAFTCYKHVHWIAPIIGSAIFGSGVYFVFTGVFAYTVDAYRRYAASGMACNTFVRCIMAGVFPLFGLQMYKSMGVNWAGFLLAMVTVAMIPVPFLFTKYGARLRAKSPYAWDD

SEQ ID NO: 134 - protein, 542 aa, Saccharomyces cerevisiae
MGNQSLVVLTESKGEYENETELPVKKSSRDNNIGESLTATAFTQSEDEMVDSNQKWQNPNYFKYAWQEYLFIFTCMISQLLNQAGTTQTLSIMNILSDSFGSEGNSKSWLMASFPLVSGSFILISGRLGDIYGLKKMLLVGYVLVIIWSLICGITKYSGSDTFFIISRAFQGLGIAFVLPNVLGIIGNIYVGGTFRKNIVISFVGAMAPIGATLGCLFAGLIGTEDPKQWPWAFYAYSIAAFINFVLSIYAIPSTIPTNIHHFSMDWIGSVLGVIGLILLNFVWNQAPISGWNQAYIIVILIISVIFLVVFIIYEIRFAKTPLLPRAVIKDRHMIQIMLALFFGWGSFGIFTFYYFQFQLNIRQYTALWAGGTYFMFLIWGIIAALLVGFTIKNVSPSVFLFFSMVAFNVGSIMASVTPVHETYFRTQLGTMIILSFGMDLSFPASSIIFSDNLPMEYQGMAGSLVNTVVNYSMSLCLGMGATVETQVNSDGKHLLKGYRGAQYLGIGLASLACMISGLYMVESFIKGRRARAAAEYDCTVA

SEQ ID NO: 135 - protein, 615 aa, Saccharomyces cerevisiae
MSSSVVGASSNKKSGIRQSCEIIERERHSNDDTYSMTSTFFKLKENEIMSAQFDSLKYKILLISTAFVCGFGISLDYTLRSTYTGYATNSYSEHSLLSTVQVINAVVSVGSQVVYSRLSDHFGRLRLFLVATIFYIMGTIIQSQATRLTMYAAGSVFYNCGYVGTNLLLTLILSDFSSLKWRMFYQYASYWPYIIIPWISGNIITAANPQKNWSWNIAMWAFIYPLSTLPIIFLILYMKYKSSKTAEWRSLKEQARKERTGGLFENLVFLFWKLDIVGILLITVSLGCILVPLTLANETSQKWHNSKIIATLVSGGCLFFIFLYWEAKFAKSPLLPFKLLSDRGIWAPLGVTFFNFFTFFISCDYLYPVLLVSMKESSTSAARIVNLPDFVAATASPFYSLLVAKTRKLKLSVIGGCAAWMVCMGLFYKYRGGSGSHEGVIAASVIMGLSGLLCSNSVIVILQAMTTHSRMAVITGIQYTFSKLGAAIGASVSGAIWTQTMPNQLYKNLGNDTLAEIAYASPYTFISDYPWGSPERDAVVESYRYVQRIIMTVGLACTVPFFTFTMFMRNPELIDKATHEEFTEDGLVVLPDEENIFSQIKALFRHNRSNKKSGC

SEQ ID NO: 136 - protein, 586 aa, Saccharomyces cerevisiae
MDKYTNRDHPDYIPGTFNIYSSQNLENGIIYESKLKKTSSGVVLIPQPSYSPNDPLNWSSWRKLAHFGLMAFITAFTAATSNDAGAAQDSLNEIYGISYDSMNTGAGVLFLGIGWSTLFLAPFANLYGRKITYIVCTTLGLFGALWFALAKRTSDTIWSQLFVGISESCAEAQVQLSLSDIFFQHQLGSVLTVYIMCTSIGTFLGPLIAGYISAFTNFRWVGWVAVIISGGLLITIIFGCEETYFDRGQYMTPLTSCQSGYEDGTTLQNSDNTAVSRRKRHLDAKLSTPGAMGEKGVDLSETAEFEVNNEEEVTIPETRELIDGSKEHLKPYPKRVAILTKATNLKGYGFKQYFKYLKINLRMFLFPPVWLSGMFWGIQDVFLTFYLTTQESAYYEPPWNYSDFGVAIMNVPTLIGAVIGCICAGIVSDYFVLWMARHNRGILEAEFRLYFSIATAIIGPAGLLMFGIGTARQWPWQAIYVGLGFVGFAWGCSGDIAMAYLMDCYPDMVLEGMVCTAIINNTISCIFTFTCSDWLAASGTENTYIALAVINFGITAFALPMYYYGKRIRLWTKRWYLQSVNLRDGV

SEQ ID NO: 137 - protein, 515 aa, Saccharomyces cerevisiae
MSTSSSVTQKNLDTNAEALKKEDKVLSEFDIQDERPKSLLWESAFVGVLCSAQLMTQAGLGQSLAPLHIIGNSFGTTNAGQLSWFASAYSLTVGTFILIAGRLGDIFGHKKFFVLGFFWYALWSLLAGFSVYSNQIFFDCCRAFQGMGPAFLLPNAIAILGRTYKPGRRKNMVFSLFGASAPGGFFLGAVFSSMLGQLAWWPWAYWIMGIACFVLAVAGYFVIPHTPMPSRDASSFKLLERIDFAGSVTGVVGLILFNFAWNQGPVVGWQTPYTYALLIVGTFFLVIFAYIESRAAFPLLPFAALSSDTAFVLSCIAAGWASFGIWIFYTWQFMEDSRGQTPLLSSAQFSPVAISGFCAAVTTGFLLSHTPPSTVMLFAMTAFTVGTILIATAPVHQTYWAQTFVSIIVMPWGMDMSFPAATIMLSDSMPHEHQGLAASLVNTVVNYSISIGLGIAGTIESRVNDGGAKPLKGYRCSWYMGIGLSGLGIFVAATYAWSTFMKSKKRISEKQHFIE

SEQ ID NO: 138 - protein, 540 aa, Saccharomyces cerevisiae
MFSIFKKKTSVQGTDSEIDEKITVKAKDKVVVSTEDEEVTTIVSSTKSTQVTNDSPWQDPTYFSSFGKELMFIATCMLAQLLNQAGQTHALCIMNVLSKSFNSEANNQAWLMASFPLAAGSFILISGRLGDIYGLKKMLIVGYVIVIVWSIISGLSKYSNSDAFFITSRAFQGVGIAFILPNIMGLVGHVYKVGSFRKNIVISFIGACAPTGGMFGGLFGGLIVTEDPNQWPWVFYAFGIATFLSLLMAWYSIPNNVPTNIHGLSMDWTGSALAIIGLILFNFVWNQAPIVGWDKPYIIVLLIISVIFLVAFFVYESKYAEVPLLPRAMTKNRHMIMILLAVFLGWGSFGIWTFYYVSFQLNLRHYSPVWTGGTYFVFVIFGSMAAFFVAFSIKRLGPALLLCFSLMAFDAGSIMFSVLPVEQSYWKLNFAMQAILCFGMDLSFPASSIILSDGLPMQYQGMAGSLVNTVINYSASLCLGMGGTVEHQINKSGNDLLKGYRAAVYLGVGLASLGVVISVTYMLENLWNRHRKSEDRSLEA

SEQ ID NO: 139 - protein, 606 aa, Saccharomyces cerevisiae
MLETDHSRNDNLDDKSTVCYSEKTDSNVEKSTTSGLRRIDAVNKVLSDYSSFTAFGVTFSSLKTALLVALFLQGYCTGLGGQISQSIQTYAANSFGKHSQVGSINTVKSIVASVVAVPYARISDRFGRIECWIFALVLYTIGEIISAATPTFSGLFAGIVIQQFGYSGFRLLATALTGDLSGLRDRTFAMNIFLIPVIINTWVSGNIVSSVAGNVAPYKWRWGYGIFCIIVPISTLILVLPYVYAQYISWRSGKLPPLKLKEKGQTLRQTLWKFADDINLIGVILFTAFLVLVLLPLTIAGGATSKWREGHIIAMIVVGGCLGFIFLIWELKFAKNPFIPRVYLGDPTIYVALLMEFVWRLGLQIELEYLVTVLMVAFGESTLSAQRIAQLYNFLQSCTNIVVGIMLHFYPHPKVFVVAGSLLGVIGMGLLYKYRVVYDGISGLIGAEIVVGIAGGMIRFPMWTLVHASTTHNEMATVTGLLMSVYQIGDAVGASIAGAIWTQRLAKELIQRLGSSLGMAIYKSPLNYLKKYPIGSEVRVQMIESYSKIQRLLIIVSISFAAFNAVLCFFLRGFTVNKKQSLSAEEREKEKLKIKQQSWLRRVIGY

SEQ ID NO: 140 - protein, 627 aa, Saccharomyces cerevisiae
MESVHSRDPVKEEKKHVFMGMEHELNPETHNDSNSDSYGLPQLSEKYNALRQNRSLIIQQTEIIGSAYNKWYLQAILLLSAFICGYGYGLDGNIRYIYTGYATSSYSEHSLLSTINVINAVVSAASQIIYARLSDVFGRLYLFISAVILYVVGTIIQSQAYDVQRYAAGAIFYNAGYVGVILILLIILSDFSSLKWRLLYQFVPTWPFIINTWIAGNITSRANPVVNWSWDVGMWAFIFPLSCVPIVLCMLHMQWRARKTPEWHALKGQKSYYQEHGFIKILKQLFWMLDVVGVLLMGCSLGCILVPLTLAGGVKTTWNDSRLIGPFVLGFVLIPILWIWEYRFARDPILPYRLVKDRAVWSSMGISFLIDFIYYMAADYLYTVMIVAVNESVKSATRIATLSSFVSTVASPFFALLVTRCTRLKPFIMFGCALWMVAMGLLYHFRGGSQSHSGIIGALCVWGVGTTLFTYPVTVSVQSAVSHENMATVTALNYTLYRIGSAVGSAVSGAIWTQTLYKQILKRMGDVALATTAYESPYTFIETYTWGTPQRNALMNAYKYVQRLETIVALVFCVPLIAFSLCLRDPKLTDTVAVEYIEDGEYVDTKDNDPILDWFEKLPSKFTFKRE

SEQ ID NO: 141 - protein, 620 aa, Saccharomyces cerevisiae
MIEVPEDNRSSQTKRKNTEKNCNELMVDEKMDDDSSPRDEMKDKLKGTKSLIIRKSELMAKKYDTWQLKAIFLFSAFICTFAYGLDSSIRGTYMTYAMNSYSAHSLISTVSVIVLMISAVSQVIFGGLSDIFGRLTLFLVSIVLYIVGTIIQSQAYDVQRYAAGAVFYYVGLVGVMLQVVLMLSDNSSLKWRLFYTLIPSWPSIITTWVSGSVVEAANPLENWSWNIAMWAFIFPLCCIPLILCMLHMRWKVRNDVEWKELQDEKSYYQTHGLVQMLVQLFWKLDVVGVLLFTAGVGCILVPLTLAGGVSTNWRNSKIIGPFVLGFVLVPGFIYWESRLALVPFAPFKLLKDRGVWAPLGIMFFICFVYQMAAGYLYTILVVAVDESASSATRIINLYSFVTAVVAPFLGLIVTRSSRLKSYIIFGGSLYFITMGLFYRYRSGQDADGGIIAGMVIWGLSSCLFDYPTIVSIQSVTSHENMATVTALNYTVFRIGGAVAAAISGAIWTQSLYPKLLHYMGDADLATAAYGSPLTFILSNPWGTPVRSAMVEAYRHVQKYEVIVALVFSAPMFLLTFCVRDPRLTEDFAQKLPDREYVQTKEDDPINDWIAKRFAKALGRS

SEQ ID NO: 142 - protein, 458 aa, Saccharomyces cerevisiae
MVANWVLALTRQFDPFMFMMVMGVGISSNILYSFPYPARWLRICSYIMFAIACLIFIAVQALQILHLIVYIKEKSFREYFNDFFRNMKHNLFWGTYPMGLVTIINFLGALSKANTTKSPTNARNLMIFVYVLWWYDLAVCLVIAWGISFLIWHDYYPLEGIGNYPSYNIKMASENMKSVLLLDIIPLVVVASSCGTFTMSEIFFHAFNRNIQLITLVICALTWLHAIIFVFILIAIYFWSLYINKIPPMTQVFTLFLLLGPMGQGSFGVLLLTDNIKKYAGKYYPTDNITREQEILTIAVPWCFKILGMVSAMALLAMGYFFTVISVVSILSYYNKKEIENETGKVKRVYTFHKGFWGMTFPMGTMSLGNEELYVQYNQYVPLYAFRVLGTIYGGVCVCWSILCLLCTLHEYSKKMLHAARKSSLFSESGTEKTTVSPYNSIESVEESNSALDFTRLA

SEQ ID NO: 143 - protein, 598 aa, Saccharomyces cerevisiae
MSFGSKVSRALRFLEIPVKDRASVSFLKNPDLQPIKSANQTWGFWSNFAYWGVMSFSVGTWMSASSALGVGLSYPETIGTFIVGDVLTIIFTLANSCPGYDWKVGFTLAQRFVFGIYGSAFGIIIRILMSIVNYGSNAWVGGLCINMILDSWSHHYLHLPNTLSSKVAMTTKELIGFIIFHVLTAFCYLMKPYHMNYILIWSCVATFFSMLGMVIYLAKQAHGVGELFTSTKSTATGSTKAWAWVYMISYWFGSVSPGSTNQSDYSRFGSSNWAIWAGTICALLIPTTLIPVFGVIGASTCDKLYGEQYWMPMDIFNHWLTTNYSAGARAGAFFCGLSFVLSQMSYTISNCGFASGMDLAGLLPKYVDIKRGALFAACVSWACLPWNFYNSSSTFLTVMSSFGVVMTPIISVMICDNFLIRKRQYSITNAFILKGEYYFTKGVNWRAIVAWVCGMTPGLPGIAWEVNNDYFHNTGIVNFFYGDSFFSFLISFFVYWGLCLLFPFKITVKHDDKDYYGAFTDEEARKKGMVPYSEISEEEIRAYTLGEGYTTGHEYRPEGSDDEIPELVKTSSENTNEFEIVHHKNNEKQSSTASEKAA

SEQ ID NO: 144 - protein, 579 aa, Saccharomyces cerevisiae
MNRDNMDTTKRKEDHTKHTTDVIEFYEEGTAASSLNIATEKANSSPSILRRIINRAAWLSKKVDAMGVESTGIQRISPYERGTSKKQFLHVAGLWLSATGGLSSMSSFLLGPLLFGLSFRESVASSLISVTIGCLIAAYCSIMGPQSGCRQMVTARYLFGWWFVKLVALASIIGVMGWSVVNSVVGGEMLAAISNDKVPLWVGIVIVTVCSFLVAIFGIKQVIKVETYLSVPVLTAFLLLYISSSDKYSFVNAYVSKGNLDSSTRKGNWMSFFSLCYSITATWGSITADYYILFPEDTPYIQIFCLTFFGTFLPTCFVGILGLLLASVAMSYKPWSVEYDSHGMGGLLWAGFQRWNGFGKFCVVVLVFSLVSNNIINTYSAAFSIQLSSVFCAKIPRWFWSIVCTIICLVCALIGRNHFSTILGNFLPMIGYWISMYFILLFEENLVFRRFFLHLYTKEFPTVTGEINGPELVGSSKEVEKDAVTNIHLLKRKHKVTKHRYNWDKWEDYEVLTHGYAATFAFIVGVAGVVVGMAQAYWIGPIAAKFGEYGGDVAMWLSMAFSGVVYPPCRYLELRKFGR

SEQ ID NO: 145 - protein, 593 aa, Saccharomyces cerevisiae
MYSIVKEIIVDPYKRLKWGFIPVKRQVEDLPDDLNSTEIVTISNSIQSHETAENFITTTSEKDQLHFETSSYSEHKDNVNVTRSYEYRDEADRPWWRFFDEQEYRINEKERSHNKWYSWFKQGTSFKEKKLLIKLDVLLAFYSCIAYWVKYLDTVNINNAYVSGMKEDLGFQGNDLVHTQVMYTVGNIIFQLPFLIYLNKLPLNYVLPSLDLCWSLLTVGAAYVNSVPHLKAIRFFIGAFEAPSYLAYQYLFGSFYKHDEMVRRSAFYYLGQYIGILSAGGIQSAVYSSLNGVNGLEGWRWNFIIDAIVSVVVGLIGFYSLPGDPYNCYSIFLTDDEIRLARKRLKENQTGKSDFETKVFDIKLWKTIFSDWKIYILTLWNIFCWNDSNVSSGAYLLWLKSLKRYSIPKLNQLSMITPGLGMVYLMLTGIIADKLHSRWFAIIFTQVFNIIGNSILAAWDVAEGAKWFAFMLQCFGWAMAPVLYSWQNDICRRDAQTRAITLVTMNIMAQSSTAWISVLVWKTEEAPRYLKGFTFTACSAFCLSIWTFVVLYFYKRDERNNAKKNGIVLYNSKHGVEKPTSKDVETLSVSDEK

SEQ ID NO: 146 - protein, 628 aa, Saccharomyces cerevisiae
MDPGIANHTLPEEFEEVVVPEMLEKEVGAKVDVKPTLTTSSPAPSYIELIDPGVHNIEIYAEMYNRPIYRVALFFSLFLIAYAYGLDGNIRYTFQAYATSSYSQHSLLSTVNCIKTVIAAVGQIFFARLSDIFGRFSIMIVSIIFYSMGTIIESQAVNITRFAVGGCFYQLGLTGIILILEVIASDFSNLNWRLLALFIPALPFIINTWISGNVTSAIDANWKWGIGMWAFILPLACIPLGICMLHMRYLARKHAKDRLKPEFEALNKLKWKSFCIDIAFWKLDIIGMLLITVFFGCVLVPFTLAGGLKEEWKTAHIIVPEVIGWVVVLPLYMLWEIKYSRHPLTPWDLIQDRGIFFALLIAFFINFNWYMQGDYMYTVLVVAVHESIKSATRITSLYSFVSVIVGTILGFILIKVRRTKPFIIFGISCWIVSFGLLVHYRGDSGAHSGIIGSLCLLGFGAGSFTYVTQASIQASAKTHARMAVVTSLYLATYNIGSAFGSSVSGAVWTNILPKEISKRISDPTLAAQAYGSPFTFITTYTWGTPERIALVMSYRYVQKILCIIGLVFCFPLLGCAFMLRNHKLTDSIALEGNDHLESKNTFEIEEKEESFLKNKFFTHFTSSKDRKD

SEQ ID NO: 147 - protein, 572 aa, Saccharomyces cerevisiae
MGSEPFQKKNLGLQINSQESGTTRSTFHSLEDLGDDVINESWDQVNQKRANIDHDVFHEHPDSSPSLSAQKAKTKEEEVAVKSSNSQSRDPSPDTQAHIPYTYFSKDQRLIIFGIIIFIGFLGPMSGNIYIPALPLLQREYDVSATTINATVSVFMAVFSVGPLFWGALADFGGRKFLYMVSLSLMLIVNILLAAVPVNIAALFVLRIFQAFASSSVISLGAGTVTDVVPPKHRGKAIAYFMMGPNMGPIIAPIVAGLILMKGNYWRWLFGFTSIMTGIALILVTALLPETLRCIVGNGDPKWGDKKDERENNESPFFEGNKISHRRLFPDIGIRKPVNNDAFFQENFPKPPKAGLTLYWKMIKCPPIIITSVSTALLFSSYYAFSVTFSYYLEHDYRFTMLEIGAAYVCPGVAMLLGSQSGGHLSDYLRSRWIKSHPKKKFPAEFRLLLNLIGILLTICGTIGYGWAIFFHYHFVVLLVFSALTAFGMTWCSNTSMTYLTELFPKRAAGTVAVSSFFRNVGAAISSAIILQLCNAMGIGWCFTGLGLCSSISLIGILYLLIFQRKYTAKEF

SEQ ID NO: 148 - DNA, 4434 bp, Artificial Sequence
  Synthetic YOR1_BY nucleotide sequence
atgacgattaccgtgggggatgcagtttcggagacggagctggaaaacaaaagtcaaaacgtggtactatctcccaaggcatctgcttcttcagacataagcacagatgttgataaggacacatcgtcttcttgggatgacaaatctttgctgcctacaggtgaatatattgtggacagaaataagccccaaacctacttgaatagcgatgatatcgaaaaagtgacagaatctgatattttccctcagaaacgtctgttttcattcttgcactctaagaaaattccagaagtaccacaaaccgatgacgagaggaagatatatcctctgttccatacaaatattatctctaacatgtttttttggtgggttctacccatcctgcgagttggttataagagaacgatacagccgaacgatctcttcaaaatggatccgaggatgtctatagagaccctttatgacgactttgaaaaaaacatgatttactattttgagaagacgaggaaaaaataccgtaaaagacatccagaagcgacagaagaagaggttatggaaaatgccaaactacctaaacatacagttctgagagctttattattcacttttaagaaacagtacttcatgtcgatagtgtttgcaattctcgctaattgtacatccggttttaaccccatgattaccaagaggctaattgagtttgtcgaagaaaaggctatttttcatagcatgcatgttaacaaaggtattggttacgctattggtgcatgtttgatgatgttcgttaacgggttgacgttcaaccatttctttcatacatcccaactgactggtgtgcaagctaagtctattcttactaaagctgccatgaagaaaatgtttaatgcatctaattatgcgagacattgttttcctaacggtaaagtgacttcttttgtaacaacagatctcgctagaattgaatttgccttatcttttcagccgtttttggctgggttccctgcaattttggctatttgcattgttttattgatcgttaaccttggacccattgccttagttgggattggtatttttttcggtgggtttttcatatccttatttgcatttaagttaattctgggctttagaattgctgcgaacatcttcactgatgctagagttaccatgatgagagaagtgctgaataatataaaaatgattaaatattatacgtgggaggatgcgtatgaaaaaaatattcaagatattaggaccaaagagatttctaaagttagaaaaatgcaactatcaagaaatttcttgattgctatggccatgtctttgcctagtattgcttcattggtcactttccttgcaatgtacaaagttaataaaggaggcaggcaacctggtaatatttttgcctctttatctttatttcaggtcttgagtttgcaaatgtttttcttacctattgctattggtactggaattgacatgatcattggattgggccgtttgcaaagcttattggaggctccagaagatgatccaaatcagatgattgaaatgaagccttctcctggctttgatccaaaattggctttaaaaatgacacattgctcatttgagtgggaagattatgaattaaacgacgctattgaagaagcaaaaggagaagctaaagatgaaggtaaaaagaacaaaaaaaagcgtaaggatacatggggtaagccatctgcaagtactaataaggcgaaaagattggacaatatgttgaaagacagagacggcccggaagatttagaaaaaacttcgtttaggggtttcaaggacttgaacttcgatattaaaaagggcgaatttattatgattacgggacctattggtactggtaaatcttcattattgaatgcgatggcaggatcaatgagaaaaactgatggtaaggttgaagtcaacggggacttattaatgtgtggttatccatggattcaaaatgcatctgtaagagataacatcatattcggttcaccattcaataaagaaaagtatgatgaagtagttcgtgtttgctctttgaaagctgatctggatattttaccggcaggcgatatgaccgaaattggggaacgtggtattactttatctggtggtcaaaaggcacgtatcaatttagccaggtctgtttataagaagaaggatatttatctattcgacgatgtcctaagtgctgtcgattctcgtgttggtaaacacatcatggatgaatgtctaaccggaatgcttgctaataaaaccagaattttagcaacgcatcaattgtcactgattgagagagcttctagagtcatcgttttaggtactgatggccaagtcgatattggtactgttgatgagctaaaagctcgtaatcaaactttgataaatcttttacaattctcttctcaaaattcggagaaagaggatgaagaacaggaagcggttgttgccggtgaattgggacaactaaaatatgaatcagaggtaaaggaattgactgaactgaagaaaaaggctacagaaatgtcacaaactgcaaatagtggtaaaattgtagcggatggtcatactagtagtaaagaagaaagagcagtcaatagtatcagtctgaaaatataccgtgaatacattaaagctgcagtaggtaagtggggttttatcgcactaccgttgtatgcaattttagtcgttggaaccacattctgctcacttttttcttccgtttggttatcttactggactgagaataaattcaaaaacagaccacccagtttttatatgggtctttactccttctttgtgtttgctgctttcatattcatgaatggccagttcaccatactttgcgcaatgggtattatggcatcgaaatggttaaatttgagggctgtgaaaagaattttacacactccaatgtcatacatagataccacacctttgggacgtattctgaacagattcacaaaagatacagatagcttagataatgagttaaccgaaagtttacggttgatgacatctcaatttgctaatattgtaggtgtttgcgtcatgtgtattgtttacttgccgtggtttgctatcgcaattccgtttcttttggtcatctttgttctgattgctgatcattatcagagttctggtagagaaattaaaagacttgaagctgtgcaacggtcttttgtttacaataatttaaatgaagttttgggtgggatggatacaatcaaagcataccgaagtcaggaacgatttttggcgaaatcagattttttgatcaacaagatgaatgaggcgggataccttgtagttgtcctgcaaagatgggtaggtattttccttgatatggttgctatcgcatttgcactaattattacgttattgtgtgttacgagagcctttcctatttccgcggcttcagttggtgttttgttgacttatgtattacaattgcctggtctattaaataccattttaagggcaatgactcaaacagagaatgacatgaatagtgccgaaagattggtaacatatgcaactgaactaccactagaggcatcctatagaaagcccgaaatgacacctccagagtcatggccctcaatgggcgaaataatttttgaaaatgttgattttgcctatagacctggtttacctatagttttaaaaaatcttaacttgaatatcaagagtggggaaaaaattggtatctgtggtcgtacaggtgctggtaagtccactattatgagtgccctttacaggttgaatgaattgaccgcaggtaaaattttaattgacaatgttgatataagtcagctgggacttttcgatttaagaagaaaattagccatcattccacaagatccagtattatttaggggtacgattcgcaagaacttagatccatttaatgagcgtacagatgacgaattatgggatgcattggtgagaggtggtgctatcgccaaggatgacttgccggaagtgaaattgcaaaaacctgatgaaaatggtactcatggtaaaatgcataagttccatttagatcaagcagtggaagaagagggctccaatttctccttaggtgagagacaactattagcattaacaagggcattggtccgccaatcaaaaatattgattttggatgaggctacatcctcagtggactacgaaacggatggcaaaatccaaacacgtattgttgaggaatttggagattgtacaattttgtgtattgctcacagactgaagaccattgtaaattatgatcgtattcttgttttagagaagggtgaagtcgcagaattcgatacaccatggacgttgtttagtcaagaagatagtattttcagaagcatgtgttctagatctggtattgtggaaaatgatttcgagaacagaagttaa

SEQ ID NO: 149 - DNA, 4434 bp, Artificial Sequence
  Synthetic YOR1-IS1 nucleotide sequence
atgacgattaccgtgggggatgcagtttcggagacggagctggaaaacaaaagtcaaaacgtggtactatctcccaaggcatctgcttcttcagacataagcacagatgttgataaagacacatcgtcttcttgggatgacaaatctttgctgcctacaggtgaatatattgtggacagaaataagccccaaacctacttgaatagcgatgatatcgaaaaagtgacagaatctgatattttccctcagaaacgtctgttttcattcttgcactctaagaaaattccagaagtaccacaaaccgatgacgagaggaagatatatcctctgttccatacaaatattatctctaacatgcttttttggtgggttctacccatcctgcgagttggttataagagaacgatacagccgaacgatctcttcaaaatggatccgaggatgtctatagagaccctttatgacgactttgaaaaaaacatgatttactattttgagaagacgaggaaaaaataccgtaaaagacatccagaagcgacagaagaagaggttatggaaaatgccaaactacctaaacatacagttctgagagctttattattcacttttaagaaacagtacttcatgtcgatagtgtttgcaattctcgctaattgtacatccggttttaaccccatgattaccaagaggctaattgagtttgtcgaagaaaaggctatttttcatagcatgcatgttaacaaaggtattggttacgctattggtgcatgtttgatgatgttcgttaacgggttgacgttcaatcatttctttcatacatcccaactgactggtgtgcaagctaagtctattcttactaaagctgccatgaagaaaatgtttaatgcatctaattatgcgagacattgttttcctaacggtaaagtgacttcttttgtaacaacagatctcgctagaattgaatttgccttatcttttcagccgtttttggctgggttccctgcaattttggctatttgcattgttttattgatcgttaaccttggacccattgccttagttgggattggtatttttttcggtgggtttttcatatccttatttgcatttaagttaattctgggctttagaattgctgcgaacatcttcactgatgctagagttaccatgatgagagaagtgctgaataatataaaaatgattaaatattatacgtgggaggatgcgtatgaaaaaaatattcaagatattaggaccaaagagatttctaaagttagaaaaatgaaactatcaagaaatttcttgattgctatggccatgtctttgcctagtattgcttcattggtcactttccttgcaatgtacaaagttaataaaggaggcaggcaacctggtaatatttttgcctctttatctttatttcaggtcttgagtttgcaaatgtttttcttacctattgctattggtactggaattgacatgatcattggattgggccgtttgcaaagcttattggaggctccagaagatgatccaaatcagatgattgaaatgaagccctctcctggctttgatccaaaattggctctaaaaatgacacattgctcatttgagtgggaagattatgaattaaacgacgctattgaagaagcaaaaggagaagctaaagatgaaggtaaaaagaacaaaaaaaagcgtaaggatacatggggtaagccatctgcaagtactaataaggcgaaaagattggacaatatgttgaaagacagagacggcccggaagatttagaaaaaacttcgtttaggggtttcaaggacttgaacttcgatattaaaaagggcgaatttattatgattacgggacctattggtactggtaaatcttcattattgaatgcgatggcaggatcaatgagaaaaattgatggtaaggttgaagtcaacggggacttattaatgtgtggttatccatggattcaaaatgcatctgtaagagataacatcatattcggttcaccattcaataaagaaaagtatgatgaagtagttcgtgtttgctctttgaaagctgatctggatattttaccggcaggcgatatgaccgaaattggggaacgtggtattactttatctggtggtcaaaaggcacgtatcaatttagccaggtctgtttataagaagaaggatatttatgtattcgacgatgtcctaagtgctgtcgattctcgtgttggtaaacacatcatggatgaatgtctaaccggaatgcttgctaataaaaccagaattttagcaacgcatcagttgtcactgattgagagagcttctagagtcatcgttttaggtactgatggccaagtcgatattggtactgttgatgagctaaaagctcgtaatcaaactttgataaatcttttacaattctcttctcaaaattcggagaaagaggatgaagaacaggaagcggttgtttccggtgaattgggacaactaaaatatgaatcagaggtaaaggaattgactgaactgaagaaaaaggctacagaaatgtcacaaactgcaaatagtggtaaaattgtagcggatggtcatactagtagtaaagaagaaagagcagtcaatagtatcagtctgaaaatataccgtgaatacattaaagctgcagtaggtaagtggggttttatcgcactaccgttgtatgcaattttagtcgttggaaccacattctgctcacttttttcttccgtttggttatcttactggactgagaataaattcaaaaacagaccacccagtttttatatgggtctttactccttctttgtgtttgctgctttcatattcatgaatggccagttcaccatactttgcgcaatgggtattatggcatcgaaatggttaaatttgagggctgtgaaaagaattttacacactccaatgtcatacatagataccacacctttgggacgtattctgaacagattcacaaaagatacagatagcttagataatgagttaaccgaaagtttacggttgatgacatctcaatttgctaatattgtaggtgtttgcgtcatgtgtattgtttacttgccgtggtttgctatcgcaattccgtttcttttggtcatctttgttctgattgctgatcattatcagagttctggtagagaaattaaaagacttgaagctgtgcaacggtcttttgtttacaataatttaaatgaagttttgggtgggatggatacaatcaaagcataccgaagtcaggaacgatttttggcgaaatcagattttttgatcaacaagatgaatgaggcgggataccttgtagttgtcctgcaaagatgggtaggtattttccttgatatggttgctatcgcatttgcactaattattacgttattgtgtgttacgagagcctttcctatttccgcggcttcagttggtgttttgttgacttatgtattacaattgcctggtctattaaataccattttaagggcaatgactcaaacagagaatgacatgaatagtgccgaaagattggtaacatatgcaactgaactaccactagaggcatcctatagaaagcccgaaatgacacctccagagtcatggccctcaatgggcgaaataatttttgaaaatgttgattttgcctatagacctggtttacctatagttttaaaaaatcttaacttgaatatcaagagtggggaaaaaattggtatctgtggtcgtacaggtgctggtaagtccactattatgagtgccctttacaggttgaatgaattgaccgcaggtaaaattttaattgacaatgttgatataagtcagctgggacttttcgatttaagaagaaaattagccatcattccacaagatccagtattatttaggggtacgattcgcaagaacttagatccatttaatgagcgtacagatgacgaattatgggatgcattggtgagaggtggtgctatcgccaaggatgacttgccggaagtgaaattgcaaaaacctgatgaaaatggtactcatggtaaaatgcataagttccatttagatcaagcagtggaagaagagggctccaatttctccttaggtgagagacaactattagcattaacaagggcattggtccgccaatcaaaaatattgattttggatgaggctacatcctcagtggactacgaaacggatggcaaaatccaaacacgtattgttgaggaatttggagattgtacaattttgtgtattgctcacagactgaagaccattgtaaattatgatcgtattcttgttttagagaagggtgaagtcgcagaattcgatacaccatggacgttgtttagtcaagaagatagtattttcagaagcatgtgttctagatctggtattgtggaaaatgatttcgagaacagaagttaa

SEQ ID NO: 150 - DNA, 1675 bp, Stevia rebaudiana
gtcaaacgcatacctacccagttagctctatatatcaaaacacctccacatctcccctttttccaccctctgccaccgtcttccacccaaacgttgactctgctctccggcgtccggcggctgctccggcgactgtggtgaagttacaaatggataatggacttgaaacgaagctactccgtcatgaagaagaagaggtcgaaggttctttgacagagagggtatggaccgaatccaaaaagatatggagggtcgcattacccggtgttatatcaagagtttgcgcgtttggaaccatcgttgtcactcaatcattcgtcggccatattagcgaaatggatcttgcaggttacgcacttgttcagacactaagtgtccgattcgtcaatggaattcttctggggatgtcaagtgcaaccgagacgctatgtggccaagcatttggggccgggcaaaaccatatgatggggatttacctgcaacgatcttggatcgttgatctgatcactttaaccgttttgctcccgattttcatcttcgggacacaagtatacaaactacttggtgaagatgaggccatagctgagagtggtggatacatatcactttggttcatcccgttcatctataacttcgtctttagcttgaccatacaaatgtttctacaagcacagttaaagaatatggtcattgcgtggctttctatctttcagttcggcatccacatcccgttgtcgtggcttttggtttataaattgggatatggggtgccgggtgccatgatcgcgttatcggcgtcgtcatggtttcttgtgattggagaatttatttacatttttggtggttggtgtccttattcttggaaaggatttacagttgctgcatttaaagacttgattcctgttgtgaagctttcgatatcatctggtgttatggtctgcttggagttatggtacaacgcggtgctggtcttgcttgctggatacatggcaaatgctgaagttgccatttctgccttttccatatgcttgaacattaacgcatgggagtttatgataagccttggcttcttaggcgctgcatgtgtacgggttgcaaatgaacttggaagaggaaatgctaaagctgcaaaattctcaattaaagttttgttggggacttcaatcgcgataggaacatttttctttgttctttgcttggtgtttggcagaagaattgcttatttgtttacaaatgatgaacgagttgcggatactgtatcagaactttccgtattactttcgttttctgtcttgctcaacagcatttatcccgttctctcaggtgtggcggttggagcaggtttacaaggcattgtagcagttgttaacctcgtttgctattacttgatcggtattccaacaggagcattgcttggatatttgacaagtctccaagtaaagggtatatggattggaatgattggtggcatcgttgctcaaacggttgcgctcgtgtacttgacatggcgaacagattgggatgatcaggtcaaaaggtcgttggaacggctcaatcggttttatgtgaaaacctctgaagagactgatgaaatttcgaactgatgatcatgttcatgttcatgtcaaatgattgaattttcataaaaagtgtaacaagtttttgtagtattttt

SEQ ID NO: 151 - DNA, 4419 bp, Stevia rebaudiana
atggaggaatacaactcaatgacgtcattcatcttcttatctccatatccacaaacactactcttggcttccattgataccgtatttctactcatcctctttgttttcgtcatccaaaagctatattcaaagttcagatcacacaacaatggcggatccaccattaacgaacctctaatcgctaaaaccttaggttctgtcaaaatcaatctctggttctatttgtcacttacagtttccgtgattctagcagttttagccattgtttcatcagttttaggattcacacagaacacgcagactcaatggaagtcaatcgacggaatttgctggttgattcaagcgatttcgtttatcgtaatcactgttgtaatcattcacgagaagagatttcaatcagtaactcatccgatttctgttcgtgtgttctggatattcaatttcatcgtcattgcactaattgcgttttcgagtatttctcgtctggtttccaacacttcatcatcaaaatccgatgacttgatttcatcgatttcactaccgttttcagctttcttgctaattgcatcagtaatcggatcaactggaatcacaataacaccagaatcaaaacctgatgaactggagaaatcggtaaacgtaagtggatgggcatctgcttcaattctatccaaaacattctggttttggatgaatccgttgctaaaaaagggctacaaaaccgtgttaacaatcgaagatatcccgacgctttcacccgaacaccgagccgaacaattgacactaatcttcgaacaaaactggcccaaacctgaagagaactcgaaccatccggttcgaaccaccctcattcggtgtttctggaaacaaactgcattcactggcttcttagcgaccgcgaagctttgtgtcgggtatgtcggaccgttgttgatacaacggttcgttgatttcacatcaggaaagaggagttctccgtacgaaggatattatttggtactgattctcctcgtcgctaagtttatcgaagctttaacgtcgcatcaattcaatttccactcgcagaagctcgggatgatgattagatcaagtttgataacatgtttatacaaaaaggggttgaaactctcgtgttcggctcgacaatcgcatggtgtaggtcaaatcgtgaactatatggcggtcgatgcgcaacagttgtcggatattatgtctcagttgcacgcgatctggctcatgccggttcaagtgaccgtggcgatggtgattctttatgcttatctcggtgcatcgacggcggttacattgatcgcggttttggtgattctagtgttcgtctatttgggtactaaactaaacaaccggtaccagtttaacataatgtcgagtcgtgatttgcggttgaaagcgatgaatgagatgttgagttacatgagggtgattaagtttcaagcttgggaagaacatttcaacgatcggattcagtcgtttcgtgactcggaatacggttggctttgtaagttcatgtactctatcggttcgaacatgatcatcttatggtgcacacctttgttaatctccactgtcacgttcgggagcgggattttgctcggtgttaaatttgacgcggggaccgtttttaccgcgacttcgttgttcaagaacttgcaagaaccgctttggagttttcctcaatcgatgatctcgctctctcaagcgatgatctcgttggggcggttggatgagtatatgatgagtaatgagttggaagagggttccgttgaaagacatgaaaacagcgacggtgaaggtaccgtcgctgttgaggtacaagacgggtcgttcagctggcatgacgacccgtcagaaggtgaaacgataaaaaatataaactttgaagtaaaaaaaggtgaactcgcggtcattgttgggacagttggttcaggaaagtcgtctttacttgcatcggttattggcgagatgcacaaaacctctggtaaggtgaaaattttcgggagcaccgcgtatgttgcacaaacctcatggatccaaaacaagacgatacaagaaaacattttgttcggtttgcctatggatagacgtaagtacaagaatgtaataagaacttgttgtttggagaaagatttagaaatgatggaattcggagatcaaaccgagatcggggagcgtgggatcaatcttagcgggggccaaaagcagcggattcaactcgcgcgagcagtttatcaagattccgacacatatcttctcgatgatgtgtttagtgctgttgatgctcatacgggttcactaatattcaaggaatgtgttaggggagtccttagagacaagacgatcttacttgttacccatcaagtagacttcctccatgacgtcgatcttatactcgtgatgcgcgatggaatgatcgttcaatcaggaaaatacgacgaactacttcaatcaggactcgatttcaaatcattagtatccgctcacgaatcctcaatgcaattagtacaatcagaatcaaccgaatcaaaagccctaacaaaatctcacagcaccaattccaacgaacacaacgactacgagagtcaaaaacctctcgaacgatcgccatcaagctccattacaggaacatcaaaattgattgaagatgaagaacgagaaacgggaagagtgagcctacatgtctacaaagtgtacgtaaccgaggctttcggatggttcggtgcggttctggttgtgttgttatcggttctatggcaagcggtgcaaatggctagcgattactggttatcttatgaaacttcagcagatcgagctgcttcgtttgatccatcggtgtttatcggagtttatgcgattattgcagggattggttttgttttgatctttggaagaactgttttctctatgtttctagggcttgaaactgctcaaaggttttttagtcagattcttcatagcatacttcatgctccaatgtcgttttttgataccacaccttctggaagaattcttagtcgggcatcaagtgatcaaaccaacatcgacattcttcttccgttcatgatgaatctaagtatcgctttgtacatgtcggttattagcgttatcatcataacctgtcaatacgcttggcctacggtcttcctactcgttccactcggttggctcaatttctggtatcgggggtattaccttgcaacatctcgtgaaataacccgacttgactcgattacaaaagcacccgttattcaccacttctcagagagcatctctggggttatgacgatccggtgttttagaaaacaagtcgagtttgttcaagaaaacgttgaccgcgttgacggaaatctacggatggattttcataataatgcatcacaaggatggttagggtttcgtatggagtttcttggaagtttgtttctttgtgcctcaactattttcatgatcattttaccgagcaacattattaaacccgaggacgttggattgtcactctcatacgggttatcactcaatggtctgttattttgggcgttatgcacgagttgtttcgttgaaaaccgaatggtttcggttgagagaataaaacaatttactaatataccctcagaagcagaatgggtgaagaaagataaacctccacctccaaattggcctactcatggcagattggagctaaaaaatttgcaggttagatatcgtccaaacacgcctcttgtgctaaaagggatcactttaaacatcgaaggtggtcaaaagatcggtgttgttggtagaacaggtggcgggaagtcaactttgatccaagttttgtttcggctggtggagcccactggcggaagtattattattgatggtattgatatatcgacactcgggttacatgatcttcggtcccgatttggtatcattccacaagaaccgatcctttttgaaggaaccgttagaagtaacattgacccgattggtcaacattctgatgatgagatttggcggagtctcgaacgctgccaactcagcgatgttgtcgctgcaaaacctggaaaacttgattccgcagttgttgataatggagataactggagtgttggacaaagacaactactttgtttaggaagggtgttgttgaaacaaagcagattattattcatggatgaagcaactgcttctgttgattcacaaacagattctgtaattcagaaaatcattcgagaagattttgctgactgtacaattgttagcattgctcataggatacctactgtcatggattgtgatcgcgttctagttattgatgcaggatatgcaaaagaatttgatgaaccgtcacgtttgattcaaagaccctcactttttggtgcgttggttcaggaatacgcgaatcgatcatcgggcatatga

SEQ ID NO: 152 - DNA, 4296 bp, Stevia rebaudiana
atggatggaactgatatatataaagcaactagtagtatacggttaggtagtttacgagcaagtggaagaacatcaagtataagatctgtaagtgcttctgtatggaggaattctggaaatgatgttttttcaagatcttcgcgtgaagaagatgatgaagaagctcttaaatgggcttcacttgagaagttaccgacgtttgatcggttgaaaaagggtttgttgtttggatcaacgggaccgtcgaacgaaattgatgttgataatcttggatttgatcagagaaagcatttgcttgatagacttgtgaaggttgctgatgaagataatgaaaagtttttgttgaaactcaggaacagaattgacagagttgggatcgatttaccaacaattgaagtcagatttgaacatttgactgtggaggcagatattaacacaggaagcagagctttgccaagtttcatcaattttcacattgatgcttttgaggggctcttgagtatgttgaatctgcttccaaattcaaagaggcatataactatccttgatgatgttagtggtgttattaaacctagcagaatgacattactattgggtcctccaagttctggtaagacctcactattgttagccttagctgggaagctagcaaaggagcttaagtgttcggggaaggtgacatacaacggccatgaattgaacgagtttgtaccggaaagaacatccgcttatattagccaaaacgatgttcatatcggagaattgacagtcagagaaaccctagctttctcagctcgatgtcaaggggttggatcacgttacgaaatgttggccgagttagcacgaagggagaaaaatgcaaacatcaaacccgatcctgatatcgatgtctacatgaaggctgcagcatcagcaggacaagaagctagtgtcgtcacagattatactctcaagttactcggtttggacatctgtgctgataccatggttggtgatcaaatgatacgtggtatttccggtggtcaaaagaaacgtgtgaccaccggtgaaatgattgtgggaccctcaaaggttcttctcatggacgaaatatcaactggtctagatagttccacaactttccaaatcgtgaaatcacttaagcagtttcttcatattcttgaaggaactgctgttatttctctcctccaacccgcacccgaaacgtatgatctgtttgatgacatcatccttttaaccgacgggaggatcgtttatcagggcccacgtgaaaatgttcttgagttttttgaatctatgggatttaaatgccctgataggaaaggtgttgctgatttcttgcaagaagttacatcaaagaaagatcaacaacaatattggatgagaagagatatgccttatagatttgtgacatcaaaagaatttgcggatgcatatcaatcatttcatgttggaagaaaattagcaaatgatttatcgttaccttatgataaaaccaaaagtcatcctgctgcacttacaaccgaaaaatacggtttagataacaaaggattgttaaaagcttgtacggatagagagatattgctcatgaaaagaaactcttttgtttatatcttcaaattgttccaattgacggtgatagggttcatcgctttgacggtgttccttagaactgagatgcatgaaagagttccagaagatggtgcgatttacgtaggggctcttttcttcggtgttgttatgctcatgtttaacgggatgtctgaaatctcaatgacgattgcgaagcttccagtgttttataaacaaagggatttcttgttttttccatcgtgggcgtacgcgttaccatcatggatcatcaaaattcccatttcgtttcttgaagctgctgtttggaccgttttgacttattatactataggatttgatcctaatgtgacaagattcttgaagcattatcttctgcttttccttgtgaaccaaatggcttctgcattatttcggttcattggtgcaatgggtagaaacatgattgttgcaaacacttttggctcattcgcacttttgttagttttcgctttgggtggatttattcttgttagagatgatgtaaagaagtggtggttgtggggatactggtcatctcctctcatgtacgccatgaatggaattactgtgaacgagtttcttggtcatcaatggagaactccatgggacaacactacacttggaagatcaacaatcacatctgtagggttctttgcagaaagttattggtattggatatcagttgcagcattagttggattcattcttgttttcaacgcgtgttttgctttatctctcgcttttctcaacccttacgggaaatcacaaggtagtgtatcgaacgaagatgaaagtgatactgttgaattgacacccgtaacacgtgatggcaatcaaagcaacaaaaagggaatgattcttccatttgaaccgcattcgattaccttcaatgatgtcaagtactcagttgatatgccacaggaaatgaaagaacaaggtgtgactgaagatagattactgttacttaagggtgtgagtggagcttttagacccggtattcttacagctctcatgggtgtaagtggggccggaaaaacaacattgatggatgtgttagcgggtcgaaaaacgggtggatacattgaaggtgatgttagggtttccgggtatcctaaaaaacaagaaacatttgctcgggtttctggatactgtgagcaaaacgatatccactctcctcatgttaccatatacgagtctttgctttactcagcttggttgaggttagccacagatgttgacgaaaaaacccgaaagagttttgttgatgaggttatggacctggtggagttgaacccgttaaaggatgcattagttgggttgccaggtgtcaatgggctctcaactgaacaaagaaagaggttaaccatagccgtggaacttgttgccaacccgtctattatctttatggatgagcccacctcggggctagatgcacgtgcagctgctattgtgatgagaactgttagaaacactgtggacacgggacgaactgtcgtgtgcaccattcatcaacctagcattgatatctttgaagcttttgatgagttgttcttgatgaaacgtggaggacaagagttgtatgttggacccgtgggtcggcattcttgcgagctaatcaagtattttgaggctataaatggtgtaagcaagattaaagaaggatataatcccgcaacatggatgttggaagtcagcacttctgctcaagaaatggctttaggggtcgattttaccgaaatctacagaaactccgatctttacaggagaaacaaagccttaatcgccgaattgagcgtgccccgacccggaacaaaagacctctatttcccgacccaatactcccaaccgttcatcgttcaatgcatcgcttgcctgtggaaacaacggaagtcatactggcggaatccgccgtacacggcggtccgattcgtcttcaccaccttcatcgccgtcatattcggtaccatgttttgggatctcggcagcaaaaaatcgacgactcgtgatctgacgaacgcaatgggatccatgtatgcagcggttctgtttcttggaatccaaaactcgatgtcggtgcaaccagtggttgatgttgaacgcaccgtcttttatagagaacgagccgccggaatgtattccgcactaccatacgcctttgctcagattctagtcgaaataccgtatattctttcacaaacaggtgtatacactgtcatagtgtacgcgatgatcgggttcgactggacggtagctaaattcttctggtacttgttctaccaattttgttgcttactctacatgacatattacggtatgatgaccgtcgctcttacaccaaacgccaacatcgccgccatcattgccgcctcattttacggaatcttcaatctattctccggtttcatcgttccacgacccaggattccggtctggtggaggtggtactactgggctaacccattagcgtggaccctttacggtatggctgtatcacagttcggtgaatttgatgatgtgctcacgaatacaaatcctccagagaccatcagacgttacttggaccgctattacgggttcaaacattctttccttcctgcggttgcaggggtacatgtcgggttggttatgtttttcgggtttatatttgcgtattgcattcggtctttcaatttccagaaaagataa

SEQ ID NO: 153 - DNA, 4842 bp, Stevia rebaudiana
atgacttttaagcccttagtttcatattgtcatcctgtggaaaatggtgtttgggcaacagcagttgaaaatgaatttgggccttatacaccctgtgcaacagattctttggttactggaatttctcatttggttcttttgggagcttgcatatacaggatatatgtcacaaaaaagaattttaaagtagaaaagtttaaattgaggtcaaacatctacaactattggttggggttattggctttatactctactgttgagcctttgtgtagattgataatgggaatttcagcttttaatgttgatggagagacttctcttgctccatatgagattatgaccttagttattaaggcacttgcatggtgttgtatgttggtcatgatcggactcgaaaccagagtttatgtttatgaagttcgttggtttgtaaggtttgcagtcgtttatgcgttgcttggtgatgcagtgttgctcaatcttgtgctttctgtgagcaaatattacacgagatatgtgttgtatctctttgtcagtgagatttccatacaggttctgtttgggttatgcttgcttgtctatcttcctactttggatccttatccgggttatactccaatacgggccgaatctttggatgatgctgaatatgaagaacttgcaggtggagaggaaatctgtcctgaaaggcgtacaaacattatttctagtattttcttctcttggatgaatcccctcatggttttgggatataaaagacctcttacagagaaggacatatggaaactggacacatgggatcagaccgaaacactacacagcaaatttgaaatatattgggcagaagagatccgtaaacctaaaccatggcttttaagggctttacatcgtagccttggtggaaggttttggtggggaggcttttggaagattggcaatgatctttctcagtttgttggaccgctgattttgaaccagctattactgtctatgcaagaacgcggtcccgctaagatcggttacatctatgcattctcaattttcgtcggagtggtacttggtgtgctgtgtgaggctcaatattttcagaatgtcatgcgtgttggttaccgccttcgttcaactctgattgctgcagtcttccggaagactttaaagctaactaacgagagtcgcagaaatattgcatctgggaaaataactaacttgatgacaaccgattctgaatcactccagcaagtaactcagtcacttcacactttgtggtctgctccttttcgtatcattatctctttggttcttctttaccaacaattaggcgttgcttcaatccttggtgcattattgctagttttcatgttccctatacagacttttgttattagtagaatgcaaaaaatgtccaaagaaggattgcagaggactgacaagagaattgggctcatgaatgaaatcttagcagccatggacactgtcaaatgctatgcttgggagaatagttttcaagacaaagtccagagtattcgatcagacgagttatcatggtttcggaaagtacaaatgctaggagcgttgaatacatttatattaaacagtattccagtggtagtaattgtggtttcatttgggttgtttactttacttggaggagaattgacacctgctagagccttcacgtcactctctttgtttgctgtacttcgttttccacttttcatgcttccaaatatgatcacacaggttgtaaatgcaaatgtgtctttgaaacgtttggaagatttacttttagagagagacttcttcttccaaatccacctcttgaaccaggacttccagctgtctcaattagaaatggattcttttcatgggattcaaagtcagataaaccaacattgtcaaatattaatttcagatatacaaacgggtagtttggtggcgattgttggaagtacaggagagggaaaaacatcagttgtatctgctatgcttggagaacttcctccagttagtgatgcggaagttgttattcgaggaacagttgcttatgttccacaagtctcatggattttcaatgcaacggtacgcgacaacatattgtttggatccccctttgattctgcaaagtatgagaagacactagatgtaactgcactgcaccatgacctagaattgcttccgggtggtgatcttactgagattggtgaaagaggagtgaatattagtggaggtcaaaaacaaagagtttccatggctagagctgtatactctgactcagatgtatatgtgtttgatgatcccttaagtgctcttgatgctcacgtgggcagacaggtttttgaaaaatgtatcaaagaagaattaagaggaaaaacgcgagtactagttacaaatcagttgcattttctttcacaagttgataggatcctattggttcatgaaggcatggtgaaagaggagggatcttacgaggaactatcacaaaacggtgtactttttcagaaattaatggagaatgcaggaaaaatggaagaatatgttgaagaacaagaagaatcaggagattcagattcgaagacatcaacacctgttactaatggtgagttagttaaagattctgctaaaaagaaagaaatcaaatctgttcttatcaagcaagaggaacgggaaacgggtgttgtcagtttcaatgttttgaagaggtataaagatgcattaggagggtggtgggttgttagtatactgttcgggtgttatgcagcaacagaaactttaagaatactaagtagcacatggttaagtatttggaccgatgaaagcactccaaagatctacagcccgttattctataatattatctatgcacttctatcacttggtcaagttcttgtgacattgggaaactcttattggttaatcatggcgagtctttatgcagctagaaagttgcacaacgcgatgcttaactccatattaagggctcctatggtcttttttcacaccaacccacttggacgtattattaatagatttgcaaaagatcttggtgatatagatcgcaacgttgcgccatttgtcaacatgtttttgggccaagtgtcacaacttttgtcaacctttgttctcattggattattgagcaccatgtctctttgggccatcttgccacttttgttgcttttctatgcagcttatttgtattatcagagcactgcgcgcgaggtaaagcgaatggattccatcacaagatctccggtgtacgcgcaatttggtgaagcattaaacggtctctccaccatccgtgcatacaaagcgtatgatcgtatggccaagattaacgggaattcaatggacaacaacatccggttcacattagtcaacatgagcgcgaaccgttggctcgcaatccgactagaaacggttggaggtctcatgatatggttaaccgcaactttcgcagtcatgcaaaacggcaaagcaagaaaccaagaagcatttgcatccaccatgggtctacttctaagttatgcattaaacatcacaagtttactgacagctgtccttagactcgcgagtttagctgaaaatagtttaaacgcggttgaacgcgttggtacttatattgaattgccttctgaggctccacctgtaatcgaagataaccgcccgccacctggctggccttcatccggatctataaagtttgaagatgttgttttgcggtatcgacctgaactgccacctgtcctccatggtttgactttttttattcctccaagtgataagattggaattgttggaagaactggtgctggaaaatctagcatgttaaatgctttgtttaggattgttgaattggaaagaggaagaattataattgataattgtgatatttcaaagtttgggttgaccgatcttcgcaaggttcttggtattattcctcaagcacccgttctcttctcagggactgtaagattcaacctggatccttttaacgagcacaatgatccggatctttgggaatctttagagagggcccacttaaaggatgttatcaggaggaatccattgggtttagatgctgaggtttcagaggctggagagaatttcagtgttggacaaagacagttattaagtctttcacgtgcattacttaggagatcaaagattcttgttcttgatgaagcaactgctgctgttgatgttagaacagatgcacttatccaaaagaccattcgtgaagaattcaagtcttgtactatgattattattgctcatcgtcttaatactattattgattgtgaccgtattcttctcctcgatgccggtcaggttgttgagtatgatgctccggtaaaacttctccaagacgaacaaaccgcattctcaaaaatggttcaaagtacaggggctgcaaatgcacaatacttacgtaacttagcatttggagcagaagaagagaaggtggagaaggtgacggttaatggtgagaagtggcggcttgcctccactcggtgggcggctgccgcccggtttgcacttgcttctagcctcactccgtcacaaaacgacctcacgcagttagaaaacgaagatgataacaacatcttaaagaaaacaaaagatgcagttctcacacttcaaggtgttttgaaaggcgaacatgataaagatattgaagagtcgcttgaacgggcccacgtcccgagggatagatggtggtcagctctttacaaagtagtcgaaggtctttcggtgatgagcaagttgggtcgtaacaagctccagctatcagaatacggggtaaatgacgaaccgattgattgggaccatgttcagatgtaa

SEQ ID NO: 154 - DNA, 4521 bp, Stevia rebaudiana
  misc_feature (26)..(26): n is a, c, g, or t
atgttcttcaacctctgttgtttgcngaaaacgacttcaggagcttcacttgtgcttcaatggctgacgttcatcttcctctctccatgccctcaaagagcacttctatctgccattgatgtcatcttcttgttcaatatccttttcgttttttgtctgctcaaaagactctattcaaggttcagttcgaccaacaatggcgactttaacacatccgccattgatgaacctctgatttctaaatctagaactgttgtcaataccaatctttggttcaagttatctctgctcgtgaccgccgttttaacagttttgtcaattgtttcttcaattttggcattcacacaacatacccagatgtcatggaagctgataaatggaatctcttggttgattcaagctctatctttccttgtgatcacagttttaatcatccatgaaaaaagatttcaagctgcaactcatccattaactcttcgtgtattcttagtagtaaatttcatcttcattgctttgttagcttcttcgggtatcatccggctagtttccggtaccggaaacacttcaattttgaaatccggcgacataatttcactcatatctctaccgttttcagcttttttattgtttgtatccgtaaccggatcaaccggaattatagtgaccatagaatctgaaccacttaatggtaatgctaatgctaatggtcacggtaaactatcagatgcttacgagttgaacaaatcttcaaacgtgagcgcatgggcgatcggcttcgatcccatcaaagatatttggttgtggatgaacccattgttgaagaaagggtataaaaaacgacctctaaaactcgaggacatcccgacactttcacccgaacatcgggccgagaaaatgtcaaaactttttgaagaaaactggccgaaaccactcgagaattccaaacatccggttcgagtcacgttaatccgttgtttttggaaacatatcgcgttcaccgcactcctcgcgatcataaggctatgtgttatgtatgtcgggccattattgatccaacggttcgttgacttcacttccggaagagatcatcaccgtacgaggggtaacttacttgatactttatcctttttgtcggctaaattcgttgaagttttgtcatcccaccagttcaatttcaactcccagaagcttggaatgttgatccgatcgacattgattacatcgctgtataaaaaggggttacggttatcgtgttcggctcgacaatcgcatggtgttggacaaatagttaactacatggctgttgatgctcaacaacttggtgatatgatgcttcaacttcatgctatttggctcatgccggttcaagtgacggttgcgttaggtattctttacgggtatctcggtgtgcccgcgttggtagctttggtcgggatcatggcggttttgttgtatgtgatatttggtgctaaaagaaacaacaggtttcagtttagtataatgcaaaaccgcgatttaaggatgaaagcagttaatgagatgcttaattacatgagggtgattaagttccaagcatgggaagaacacttcaacaagaggatacaagcgtttcgcgagtctgaatacgggtggcttacgaaattcatgttttcaataggtggaaacttgattgtgttatggagcgcgcctttgttcgtctcgtcactcacttttggaagcgcgattctgctcgggatcccgctggatgcagccacggtgttcactgccacatcgttgttcaagaacttgcaagagccgattcgcacgttcccgcagtcaatgatctctctttctcaggccatgatatcactgggaagattggacgctttcatgttgagtaaagagttggatgagcgggcggttgagaggcgtgagggttgcggtgatgggaccgcggttgaggtcagcaacgggtcttttagctgggatgatgaagctgctgatggtgctgtagttaagaatttgagttttgagatcaagaaaggtgaacttgcagctattgttgggaccgtggggtccggtaaatcgtcgcttctttcgtccgttataggcgagatgcacaaaatctccggaaaggtgagggtatgtgggagtactgcatatgttgcacaaacagcatggattcaaaacgggacgattcaagagaacattttgtttggtttgccaatggatcgacagaaatacaaggaagttatcaaaacctgttgtttggagaaagatttagaaatgatggaatatggagaccaaactgagatcggagagcgcggaattaatctcagtggtggtcagaagcaaaggattcaacttgcacgcgctgtttatcaagattgtgacatttatcttcttgatgatgtttttagcgcggttgatgctcacaccggttcagaaatattcaaggaatgtgtaaggggggctctacggaacaaaacaatcttactcgtcacacaccaagttgatttcctccataatgtcgatcaaatcctagttatgcgcgatggaatgattgttcaatcaggaaagtacgacgaactactagaatccggtatggatttcaaagctttagtttccgcgcacgaaacctctatgcaactagttgaaatggaacccaccacatcagatcacacctctcctagacctcttcaaaaatccccaagcttaaaccctagagaagaggcattagaacgatcaaaatcaagttctataatcggtacatcaaaactaattgaagaagaagagagggaaacaggaagaatcagtttaggtgtttataaggtttatgtgaccgaagctttcggatggtggggtgtgattgttgttttaatgttttcaatcttgtggcaagggtcacagatggcgagtgattactggttggcatatgaaacttctgatgaacacattttcaacccttcgttgtttatacaagtgtatacagctatagcgggtctttcgttgcttttggtatttggtaggattatttcttcgacgttccttgggcttaaaacttcccagatattttttaaccagattcttcacagcatccttcatgctccaatgtcgttttttgacactacaccttctggaagaattcttagcagggcatcaagtgatcaaacaaacctcgatgtcttccttccattcatgatgaacttgacggttgcgatgtacataacagtgatcggtattgtaatcatcacttgtcagtatgcttggccaactgtcttcctattaattcctcttggttggctcaatttttggtttcggggatactatctggcaacatcccgtgaaataactagactcgactcgattacaaaagcacccgttattcaccatttttcggagagcatctcgggggttatgacaattcggtgttttaagaagcaagacaggtttgttgaagaaaatgttaaccgcgtgaacgcaaacctgagaatggattttcataataacgggtctaacgggtggttaggtttccggttggagtttcttggaagtttatttctatgtatttccactgtgttcatgatcattttacctagcagcattgttaaaccagaaaacgttggattatcactctcgtatggattgtcactcaacggagtgctgttttgggctttatatatgagctgttttgttgaaaaccgaatggtttcggttgaaaggattaaacaattcattagaataccgtcggaagccgaatgggtgaaaaaagataatcttccaccatcaaactggcctgatcatggaaatgtagagcttaaagatttgcaggttagatatcgtccaaatacgcctttagtgatcaaagggattactctaagtatcaatggaggtgaaaagatcggtgtggttggtagaaccggtggcgggaaatcaactttgatccaggttctgtttaggttggtggagccatctggcggaagtataaccattgatgggatcaacatctcgacccttggattacatgatctaaggtcaagatttgggatcattcctcaagaaccaattctttttgaaggaactgttagaagcaatattgaccccattggtcaacattctgatgaagagatctggaggagtcttgaacgatgccaacttaatgatgttgtagctgcaaaacctggaaaacttgattctgcagttgttgataatggtgataattggagtgttggtcaaagacaacttctatgtttgggaagagtgatgttgaaacacagtaaactgttgttcatggatgaagcaacagcttcagttgattcacaaacagatgcggtgattcagaaaatcatacgcgaggagtttgctgactgtaccatcattagcattgctcacagaatacctactgtcatggactgtgatcgcgttctcgtcatcgatgctggttacgcgaaagaatttgataaaccgtcacggttgattgagagaccttcattatttggggctttggttcaagagtatgcaaaccggtcttctggtctatga

SEQ ID NO: 155 - DNA, 4560 bp, Stevia rebaudiana
atgacatctgattcattttggatcacttctgtttcatgttcttcaacctctgttattgcagaaaacgcatcaggagcttcactcatacttcaatggctgaaattcatctttctctctccatgccctcaaagggtacttttatccgccattgacgtcatcttcttattcatcctcttcgttttcgctgttcaaaagctctattcaaaattcacctccagcaaatccgccattaacgaacctctgattactaaaaacagatctatcgtcaacaccaatctctggttcaaatcatctctggtagtgacaaccgttttaacggttttgtcgattgcttcttcagttttggcattcacacagaatactcaggtaccatggaaactgattaatggattctgttggttaattcaagctttatctttccttgtaatcacggttttgattatccatgaaaaaagatttcaagctgcaactcatccattaactcttcgtgtattcttgatagtgaatttcatcttcatcgctctattggcttcttcgggtatcatccggttaacttccgatacccgaaacacttcatttttcaaatccggtgacataatttcgttactatctctaccgttttcggttttcttattggttgtatcgataaccggatcaaccggaatcttagtgattctagattctgaatcaccgaacatcagcagtagcagtaatagtaatagtaatggtaatggtcatagtaaagtatcagatgctgatgagttgaacatcaactcatcagaactgagcggatgggcatccgcttcgatcatttcaaaagtcttttggttatggatcaacccgttgttgaaaaaagggtacgaaacccctttaaagctagaggacgtcccgacgctttcacccgaccatcgcgcagaaaaaatgtcgaaacgtttcaaagaaaactggcctaagcctcaagaaaactgtaaacatcctgttcgtgtcacgttgattcgttgtttctggaaagacgtcgccttcacagcgtttctagcgatgatacgcttgtgtgtaatgtacgtcgggccattgttgatccaacggtttgttgattacacttccgggaaacgaacgtcaccatacgaggggtattatttgatatcagtccttttggtggctaaatttgttgaagttttatcatcccatcagttcaatttccattcccaaaagcttggaatgttgatccgatcaacgttgattacatcattgtataaaaaagggttacggttatcgtgttcgggtcgacaatcgcatggtgttggacaaatagttaactacatgtctgttgatactcaacaacttggtgatatgatgtttcaattgcatgctatttggttaatgccgcttcaagtgacgattgcgttagtcattctctacatgtaccttggaccgtcgagtttagtagcattaatcgggatcttgttgatcatgttgtatactattttgggtactaaaaggaacaataagtttcaatatagtataatgcaaagtcgtgattcgaggatgaaagcaactaatgagatgcttaattacatgagggtgattaagtttcaagcatgggaagaacacttcaacaagaggatacaatcgtttcgcgagtctgaatacgggtggcttacgaaattcatgctctcaatcggtggaaacatgattgtgttatggagcgcgccattgtttacctctgtactcacctttggaagcgcgatattgtttggagtcccgcttgatgcgggcaccgtgtttactgctacctcgttgtttaagaacttgcaagagccaattcgcacgttccctcaatcgatgattcaaatttctcaggctatgatctcattgggaagattggacgcgttcatgttgactaaagagttggatgacgaggcggttgagaggcgcgagggttgcggtggtgggaccgcggttgaggtcagcaacgggtcttttagctgggatgatgaagctgctgatggtgctgtagttaagaatttgaattttgagatcaagaaaggtgaacttgcagcaattgttgggaccgtggggtccggtaaatcgtcgcttctttcgtccgttataggcgagatgcacaaaatctccggaaaggtgagggtatgtggaagcactgcatatgttgcacaaacagcatggattcaaaatgggacgattcaagaaaacattttgtttggtttaccaatggatagacagaaatacaaagaagttatcaagagctgctgtttggaaaaagatatagaaatgatggaattcggagaccaaacagagatcggagaacgtgggattaatctcagtggtggtcagaagcaaaggattcaacttgcacgcgctgtttatcaagattgtgacatttatcttcttgatgatgtttttagcgcggttgatgctcacactggttcagatatattcaaggagtgtgtcagggggatccttcgagacaagacaatcttactcgtcacacaccaagttgatttccttcataatgtcgatttgatcttagtgatgcgagacggggagattgtccaatcaggaaagtatgatgaactactagaatcgggtttagattttcaatcgttagtttccgcccacgagaactctatgcaactagttgaaatggaaccaaccacatcggataaaaactcccgtaaagctcttaataaatctcctagcatacatcctcaagaagaagataagaaggttctagaaaaatccggatctagttctaacattggaacatcaaagttaatcaaagaagaggagagggaaacaggaagaatcggtttaggtgtttataaggtttatgtaaccgaagcgttcggatggtggggtgtgcttattgtgttgttgttttcagtcttgtggcaagcgacacagatggcaagtgattactggttgtcgtatgaaactgctgatgaacgcgccgcctcttttaatccttcgctatttatagaagtttatgcagctattgccggtgtttctttccttatggtgtttagtagagtcatttcttcaacggtccttgggcttcaaacttgtcagattttctttaagcagattcttcatagcatgcttcatgctccaatgtcatttttcgacactacaccttccggacgtgttcttagtagggcatcaagtgatcaagcaaacattgatcttctgcttccatttatgacgagtatgactcttacgatgtacatatcagtgattgccactatcatcatcatttgtcagtacgcttggccaacggtgtttctactaattcctcttggttggctcaacttttggtaccgcggatactatcttgcagcatctcgtgaaatcacacggctcgattcaattacaaaagcacccgttattcaccatttctcggaaagcatcgcaggggtgatgacaattcggtgttttaagaagcaagaaggctttattcatgaaaaccttgatcgtgtgaacggaaacttgagaatggatttccacaactggggagcgactgagtggttaggtttccgtttggagtttctcggaagcttatttatgtgtgtttcaactgtgttcatgatcatcttacctagtaccattgtcaaaccagagaatgttggattatcactctcatatgggttaacactcaacgggatattgttttttgctgtatatatgagttgtatggtagaaaacagaatggtttctgttgaaaggattaaacagttctccaaaataccatcagaagccgaatgggttaaaaaagataatcctccaccatcaaactggcctaatcatggaaatgtagagctcaaagatttgcaggttagatatcgtccaaatacgcctttggtgatcaaagggattactctaagtattaaaggaggtgaaaagatcggtgtggttggtagaaccggtggcggtaaatcaactctgattcaagttatgtttaggttggtggagccatctggcggaagtataaccgttgatggtatcgatatcacaactctcggactacatgatctcagatcaagattcgggatcattcctcaagaaccaatcctatttgaaggcaccgtgagaagtaatattgaccccattggtcaacattctgatgaagaaatctggaggagtcttgaacgatgccagctttatgatgttgtatctgcgaaacctggtaaactagattctgcagttgttgataatggtgataactggagtgtgggacaaagacaacttctatgtttgggaagagtgatgttgaaacacagcaaactgttgttcatggatgaagcaacagcttcagttgattcacaaacagatgcggtgattcaaaaaatcatacgcgaggattttgctgactgtaccatcatcagcattgctcacagaataccaactgtcatggactgtgatcgcgttcttgtcatcgatgctggttacgcgaaagaatttgataaaccttcacggttgatagagagaccttcgttgtttggtgcattggttcaggagtacgcaaacaggtcatcgggattatga

SEQ ID NO: 156 - protein, 567 aa, Saccharomyces cerevisiae
MSGVNNTSANELSTTMSNSNSAVGAPSVKTEHGDSKNSLNLDANEPPIDLPQKPLSAYTTVAILCLMIAFGGFIFGWDTGTISGFVNLSDFIRRFGQKNDKGTYYLSKVRMGLIVSIFNIGCAIGGIVLSKVGDIYGRRIGLITVTAIYVVGILIQITSINKWYQYFIGRIISGLGVGGIAVLSPMLISEVAPKHIRGTLVQLYQLMGTMGIFLGYCTNYGTKNYHNATQWRVGLGLCFAWATFMVSGMMFVPESPRYLIEVGKDEEAKRSLSKSNKVSVDDPALLVEYDTIKAGIELEKLAGNASWSELLSTKTKVFQRVLMGVMIQSLQQLTGDNYFFYYGTTIFKSVGLKDSFQTSIIIGVVNFFSSFIAVYTIERFGRRTCLLWGAASMLCCFAVFASVGVTKLWPQGSSHQDITSQGAGNCMIVFTMFFIFSFATTWAGGCYVIVSETFPLRVKSRGMAIATAANWMWGFLISFFTPFITGAINFYYGYVFLGCLVFAYFYVFFFVPETKGLTLEEVNTMWLEGVPAWKSASWVPPERRTADYDADAIDHDNRPIYKRFFSS

SEQ ID NO: 157 - DNA, 1527 bp, Escherichia coli
gagatgacgttggaggggcaaggtcgcgctgattgctggggcaacacgtggagcggatcggggattgtctttcttcagctcgctgatgatatgctgacgccaatgccgtttggcctccgactaacgaaaatcccgcatttggacggctgatccgattggcacggcggacggcgaatggcggagcagacgctcgtccgggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagagtagatgccgaccgaacaagagctgatttcgagaacgcctcagccagcaactcgcgcgagcctagcaaggcaaatgcgagagaacggccttacgcttggtggcacagttctcgtccacagttcgctaagctcgctcggctgggtcgcgggagggccggtcgcagtgattcaggcccttctggattgtgttggtccccagggcacgattgtcatgcccacgcactcgggtgatctgactgatcccgcagattggagatcgccgcccgtgcctgccgattgggtgcagatct

SEQ ID NO: 158 - DNA, 1422 bp, Artificial Sequence
  Codon-optimized UGT91D2e nucleotide sequence
atggctacatctgattctattgttgatgacaggaagcagttgcatgtggctactttcccttggcttgctttcggtcatatactgccttacctacaactatcaaaactgatagctgaaaaaggacataaagtgtcattcctttcaacaactagaaacattcaaagattatcttcccacatatcaccattgattaacgtcgttcaattgacacttccaagagtacaggaattaccagaagatgctgaagctacaacagatgtgcatcctgaagatatcccttacttgaaaaaggcatccgatggattacagcctgaggtcactagattccttgagcaacacagtccagattggatcatatacgactacactcactattggttgccttcaattgcagcatcactaggcatttctagggcacatttcagtgtaaccacaccttgggccattgcttacatgggtccatccgctgatgctatgattaacggcagtgatggtagaactaccgttgaagatttgacaaccccaccaaagtggtttccatttccaactaaagtctgttggagaaaacacgacttagcaagactggttccatacaaggcaccaggaatctcagacggctatagaatgggtttagtccttaaagggtctgactgcctattgtctaagtgttaccatgagtttgggacacaatggctaccacttttggaaacattacaccaagttcctgtcgtaccagttggtctattacctccagaaatccctggtgatgagaaggacgagacttgggtttcaatcaaaaagtggttagacgggaagcaaaaaggctcagtggtatatgtggcactgggttccgaagttttagtatctcaaacagaagttgtggaacttgccttaggtttggaactatctggattgccatttgtctgggcctacagaaaaccaaaaggccctgcaaagtccgattcagttgaattgccagacggctttgtcgagagaactagagatagagggttggtatggacttcatgggctccacaattgagaatcctgagtcacgaatctgtgtgcggtttcctaacacattgtggttctggttctatagttgaaggactgatgtttggtcatccacttatcatgttgccaatctttggtgaccagcctttgaatgcacgtctgttagaagataaacaagttggaattgaaatcccacgtaatgaggaagatggatgtttaaccaaggagtctgtggccagatcattacgttccgttgtcgttgaaaaggaaggcgaaatctacaaggccaatgcccgtgaactttcaaagatctacaatgacacaaaagtagagaaggaatatgtttctcaatttgtagattacctagagaaaaacgctagagccgtagctattgatcatgaatcctaa

SEQ ID NO: 159 - DNA, 2079 bp, Artificial Sequence
  Codon-optimized A. thaliana ATR1 nucleotide sequence
atgacttctgcactttatgcctccgatcttttcaaacaattgaaaagtatcatgggaacggattctttgtccgatgatgttgtattagttattgctacaacttctctggcactggttgctggtttcgttgtcttattgtggaaaaagaccacggcagatcgttccggcgagctaaagccactaatgatccctaagtctctgatggcgaaagatgaggatgatgacttagatctaggttctggaaaaacgagagtctctatcttcttcggcacacaaaccggaacagccgaaggattcgctaaagcactttcagaagagatcaaagcaagatacgaaaaggcggctgtaaaagtaatcgatttggatgattacgctgccgatgatgaccaatatgaggaaaagttgaaaaaggaaacattggctttcttttgtgtagccacgtatggtgatggtgaaccaaccgataacgccgcaagattctacaagtggtttactgaagagaacgaaagagatatcaagttgcagcaacttgcttacggcgtttttgccttaggtaacagacaatacgagcactttaacaagataggtattgtcttagatgaagagttatgcaaaaagggtgcgaagagattgattgaagtcggtttaggagatgatgatcaatctatcgaggatgactttaatgcatggaaggaatctttgtggtctgaattagataagttacttaaggacgaagatgataaatccgttgccactccatacacagccgtcattccagaatatagagtagttactcatgatccaagattcacaacacagaaatcaatggaaagtaatgtggctaatggtaatactaccatcgatattcatcatccatgtagagtagacgttgcagttcaaaaggaattgcacactcatgaatcagacagatcttgcatacatcttgaatttgatatatcacgtactggtatcacttacgaaacaggtgatcacgtgggtgtctacgctgaaaaccatgttgaaattgtagaggaagctggaaagttgttgggccatagtttagatcttgttttctcaattcatgccgataaagaggatggctcaccactagaaagtgcagtgcctccaccatttccaggaccatgcaccctaggtaccggtttagctcgttacgcggatctgttaaatcctccacgtaaatcagctctagtggccttggctgcgtacgccacagaaccttctgaggcagaaaaactgaaacatctaacttcaccagatggtaaggatgaatactcacaatggatagtagctagtcaacgttctttactagaagttatggctgctttcccatccgctaaacctcctttgggtgttttcttcgccgcaatagcgcctagactgcaaccaagatactattcaatttcatcctcacctagactggcaccatcaagagttcatgtcacatccgctttagtgtacggtccaactcctactggtagaatccataagggcgtttgttcaacatggatgaaaaacgcggttccagcagagaagtctcacgaatgttctggtgctccaatctttatcagagcctccaacttcaaactgccttccaatccttctactcctattgtcatggtcggtcctggtacaggtcttgctccattcagaggtttcttacaagagagaatggccttaaaggaggatggtgaagagttgggatcttctttgttgtttttcggctgtagaaacagacaaatggatttcatctacgaagatgaactgaataactttgtagatcaaggagttatttcagagttgataatggctttttctagagaaggtgctcagaaggagtacgtccaacacaaaatgatggaaaaggccgcacaagtttgggacttaatcaaagaggaaggctatctatatgtctgtggtgatgcaaagggtatggcaagagatgttcacagaacacttcatactatagtccaggaacaggaaggcgttagttcttctgaagcggaagcaattgtgaaaaagttacaaacagagggaagatacttgagagatgtgtggtaa

The invention claimed is:

1. A recombinant microorganism capable of producing a steviol glycoside in a cell culture, wherein the microorganism has a reduced expression of at least one endogenous transporter gene encoding a polypeptide having at least 90% sequence identity to the amino acid sequence set forth in SEQ ID NO: 107;

wherein the reduced expression is produced in the microorganism by disrupting or deleting a gene locus to by disrupting or deleting the gene locus for the at least one endogenous transporter gene;

wherein the microorganism further comprises:
(a) a gene encoding a polypeptide capable of synthesizing steviol from ent-kaurenoic acid;
  wherein the polypeptide comprises a polypeptide having at least 90% sequence identity to one of the amino acid sequences set forth in any one of SEQ ID NOs: 11-17 or 19;
and further comprises:
(b) a gene encoding a polypeptide capable of glycosylating steviol or a steviol glycoside at its C-13 hydroxyl group;
  wherein the polypeptide comprises a polypeptide having at least 90% sequence identity to one of the amino acid sequences set forth in any one of SEQ ID NOs: 30 or 91;
(c) a gene encoding a polypeptide capable of beta 1,3 glycosylation of the C3' of the 13-O-glucose, 19-O-glucose, or both 13-O-glucose and 19-O-glucose of a steviol glycoside;
  wherein the polypeptide comprises a polypeptide having at least 90% sequence identity to one of the amino acid sequences set forth in any one of SEQ ID NOs: 85or 89;
(d) a gene encoding a polypeptide capable of glycosylating steviol or a steviol glycoside at its C-19 carboxyl group;
  wherein the polypeptide comprises a polypeptide having at least 90% sequence identity to one of the amino acid sequences set forth in any one of SEQ ID NOs: 29 or 88;
  and/or
(e) a gene encoding a polypeptide capable of beta 1,2 glycosylation of the C2' of the 13-O-glucose, 19-O-glucose, or both 13-O-glucose and 19-O-glucose of a steviol glycoside;
  wherein the gene has a copy number of 2 or more; and
  wherein the polypeptide comprises a polypeptide having at least 90% sequence identity to one of the amino acid sequences set forth in any one of SEQ ID NOs: 51, 54, 55, 86, or 90;
  wherein at least one of the genes in items (a)-(e) is a recombinant gene; and
  wherein the steviol glycoside is Rebaudioside A, Rebaudioside B, Rebaudioside D, Rebaudioside E, Rebaudioside M, or an isomer thereof.

2. The recombinant microorganism of claim 1, wherein the endogenous transporter gene encodes an ATP-Binding Cassette (ABC) transporter or a Major Facilitator Superfamily (MFS) transporter.

3. The recombinant microorganism of claim 1, further comprising:
(a) one or more genes encoding a sucrose transporter (SUC1) polypeptide and a sucrose synthase (SUS1) polypeptide;
  wherein the SUS1 polypeptide comprises a polypeptide having an amino acid sequence set forth in any one of SEQ ID NOs: 78 or 80;
(b) a gene encoding a polypeptide capable of synthesizing geranylgeranyl pyrophosphate (GGPP) from farnesyl diphosphate (FPP) and isopentenyl diphosphate (IPP);
  wherein the polypeptide comprises a polypeptide having an amino acid sequence set forth in any one of SEQ ID NOs: 43-50;
(c) a gene encoding a polypeptide capable of synthesizing ent-copalyl diphosphate from GGPP;
  wherein the polypeptide comprises a polypeptide having an amino acid sequence set forth in any one of SEQ ID NOs: 33-39;
(d) a gene encoding a polypeptide capable of synthesizing ent-kaurene from ent-copalyl pyrophosphate;
  wherein the polypeptide comprises a polypeptide having an amino acid sequence set forth in any one of SEQ ID NOs: 1-6;
(e) a gene encoding a polypeptide capable of synthesizing ent-kaurenoic acid from ent-kaurene;
  wherein the polypeptide comprises a polypeptide having an amino acid sequence set forth in any one of SEQ ID NOs: 7-10; and/or
(f) a gene encoding a polypeptide capable of reducing cytochrome P450 complex;
  wherein the polypeptide comprises a polypeptide having an amino acid sequence set forth in any one of SEQ ID NOs: 20-22, 27, or 28;
  wherein at least one of the genes is a recombinant gene.

4. The recombinant microorganism of claim 1, wherein at least one of the genes in items (a)-(e) is codon optimized for expression in the microorganism.

5. The recombinant microorganism of claim 1, comprising the genes encoding:
(a) the polypeptide capable of glycosylating steviol or a steviol glycoside at its C-13 hydroxyl group; the polypeptide capable of beta 1,3 glycosylation of the C3' of the 13-O-glucose, 19-O-glucose, or both 13-O-glucose and 19-O-glucose of a steviol glycoside; and the polypeptide capable of beta 1,2 glycosylation of the C2' of the 13-O-glucose, 19-O-glucose, or both 13-O-glucose and 19-O-glucose of a steviol glycoside;
(b) the polypeptide capable of glycosylating steviol or a steviol glycoside at its C-13 hydroxyl group; the polypeptide capable of beta 1,3 glycosylation of the C3' of the 13-O-glucose, 19-O-glucose, or both 13-O-glucose and 19-O-glucose of a steviol glycoside; the polypeptide capable of glycosylating steviol or a steviol glycoside at its C-19 carboxyl group; and the polypeptide capable of beta 1,2 glycosylation of the C2' of the 13-O-glucose, 19-O-glucose, or both 13-O-glucose and 19-O-glucose of a steviol glycoside; or
(c) the polypeptide capable of glycosylating steviol or a steviol glycoside at its C-13 hydroxyl group; the polypeptide capable of glycosylating steviol or a steviol glycoside at its C-19carboxyl group; and the polypeptide capable of beta 1,2 glycosylation of the C2' of the 13-O-glucose, 19-O-glucose, or both 13-O-glucose and 19-O-glucose of a steviol glycoside.

6. A method of affecting excretion of a steviol glycoside from a cell culture, comprising culturing the recombinant microorganism of claim 1 under conditions in which the genes are expressed;
  wherein the steviol glycoside is produced by the recombinant microorganism.

7. A method of producing a steviol glycoside in a cell culture, comprising culturing the recombinant microorganism of claim 1 under conditions in which the genes are expressed;
  wherein culturing includes inducing expression of the one or more of the genes; and
  wherein the steviol glycoside is produced by the recombinant microorganism.

8. The method of claim 7, wherein:
(a) Rebaudioside A is synthesized in the recombinant microorganism expressing the polypeptide capable of glycosylating steviol or a steviol glycoside at its C-13 hydroxyl group; the polypeptide capable of beta 1,3 glycosylation of the C3' of the 13-O-glucose, 19-O-glucose, or both 13-O-glucose and 19-O-glucose of a steviol glycoside; the polypeptide capable of glycosylating steviol or a steviol glycoside at its C-19 carboxyl group; and the polypeptide capable of beta 1,2 glycosylation of the C2' of the 13-O-glucose, 19-O-glucose, or both 13-O-glucose and 19-O-glucose of a steviol glycoside;

(b) Rebaudioside B is synthesized in the recombinant microorganism expressing the polypeptide capable of glycosylating steviol or a steviol glycoside at its C-13 hydroxyl group; the polypeptide capable of beta 1,3 glycosylation of the C3' of the 13-O-glucose, 19-O-glucose, or both 13-O-glucose and 19-O-glucose of a steviol glycoside; and the polypeptide capable of beta 1,2 glycosylation of the C2' of the 13-O-glucose, 19-O-glucose, or both 13-O-glucose and 19-O-glucose of a steviol glycoside;

(c) Rebaudioside D is synthesized in the recombinant microorganism expressing the polypeptide capable of glycosylating steviol or the steviol glycoside at its C-13 hydroxyl group; the polypeptide capable of beta 1,3 glycosylation of the C3' of the 13-O-glucose, 19-O-glucose, or both 13-O-glucose and 19-O-glucose of a steviol glycoside; the polypeptide capable of glycosylating steviol or a steviol glycoside at its C-19 carboxyl group; and the polypeptide capable of beta 1,2 glycosylation of the C2' of the 13-O-glucose, 19-O-glucose, or both 13-O-glucose and 19-O-glucose of a steviol glycoside;

(d) Rebaudioside E is synthesized in the recombinant microorganism expressing the polypeptide capable of glycosylating steviol or a steviol glycoside at its C-13 hydroxyl group; the polypeptide capable of glycosylating steviol or a steviol glycoside at its C-19 carboxyl group; and the polypeptide capable of beta 1,2 glycosylation of the C2' of the 13-O-glucose, 19-O-glucose, or both 13-O-glucose and 19-O-glucose of a steviol glycoside; and/or (e) Rebaudioside M is synthesized in the recombinant microorganism expressing the polypeptide capable of glycosylation of the 13-OH of steviol; the polypeptide capable of beta 1,3 glycosylation of the C3' of the 13-O-glucose, 19-O-glucose, or both 13-O-glucose and 19-O-glucose of a steviol glycoside; the polypeptide capable of glycosylating steviol or a steviol glycoside at its C-19 carboxyl group; and the polypeptide capable of beta 1,2 glycosylation of the C2' of the 13-O-glucose, 19-O-glucose, or both 13-O-glucose and 19-O-glucose of a steviol glycoside.

9. The method of claim 7, wherein the steviol glycoside is produced at a concentration of at least 500 mg/L of the cell culture.

10. The method of claim 7, that further comprises isolating the Rebaudioside M, alone or together with at least one other steviol glycoside from the cell culture.

11. The method of claim 7, wherein the isolating step comprises separating a liquid phase of the cell culture from a solid phase of the cell culture to obtain a supernatant comprising Rebaudioside M, alone or together with at least one other steviol glycoside, and:

(a) contacting the supernatant with one or more adsorbent resins in order to obtain at least a portion of Rebaudioside M, alone or together with at least one other steviol glycoside; or (b) contacting the supernatant with one or more ion exchange or reversed-phase chromatography columns in order to obtain at least a portion of Rebaudioside M, alone or together with at least one other steviol glycoside; or (c) crystallizing or extracting Rebaudioside M, alone or together with at least one other steviol glycoside;

thereby isolating Rebaudioside M, alone or together with at least one other steviol glycoside.

12. The method of claim 7, that further comprises recovering a steviol glycoside composition comprising Rebaudioside M, alone or together with at least one other steviol glycoside from the cell culture.

13. The method of claim 12, wherein the recovered steviol glycoside composition is enriched for Rebaudioside M relative to a steviol glycoside composition of *Stevia* plant and has a reduced level of *Stevia* plant-derived components relative to a steviol glycoside composition obtained from a plant-derived *Stevia* extract.

14. The method of claim 7, wherein the cell culture comprises:

(a) the steviol glycoside produced by the recombinant host cell;

(b) glucose, fructose, sucrose, xylose, rhamnose, uridine diphosphate (UDP)-glucose, UDP-rhamnose, UDP-xylose, and/or N-acetyl-glucosamine; and/or (c) supplemental nutrients comprising trace metals, vitamins, salts, yeast nitrogen base (YNB) and/or amino acids.

15. The recombinant microorganism of claim 1, wherein the recombinant microorganism is a plant cell, a mammalian cell, an insect cell, a fungal cell from *Aspergillus* genus, or a yeast cell from *Saccharomyces cerevisiae, Schizosaccharomyces pombe, Yarrowia lipolytica, Candida glabrata, Ashbya gossypii, Cyberlindnera jadinii, Pichia pastoris, Kluyveromyces lactis, Hansenula polymorpha, Candida boidinii, Arxula adeninivorans, Xanthophyllomyces dendrorhous*, or *Candida albicans* species, an algal cell or a bacterial cell from *Escherichia coli* species, or *Bacillus* genus.

16. The method of claim 7, wherein the recombinant host cell is grown in a fermentor at a temperature for a period of time, wherein the temperature and the period of time facilitate the production of the steviol glycoside composition.

17. A cell culture, comprising the recombinant microorganism of claim 1, the cell culture further comprising:

(a) the steviol glycoside produced by the recombinant microorganism;

(b) glucose, fructose, sucrose, xylose, rhamnose, uridine diphosphate (UDP)-glucose, UDP-rhamnose, UDP-xylose, and/or N-acetyl-glucosamine; and (c) supplemental nutrients comprising trace metals, vitamins, salts, YNB, and/or amino acids;

wherein the steviol glycoside is present at a concentration of at least 1 mg/liter of the cell culture.

18. The method of claim 7, wherein the recombinant microorganism is a fungal cell or a yeast cell.

19. The recombinant microorganism of claim 1, wherein the recombinant microorganism is a *Saccharomyces cerevisiae* cell.

20. The method of claim 7, wherein the recombinant microorganism is a *Saccharomyces cerevisiae* cell.

21. The method of claim 7, wherein Rebaudioside A is synthesized in the recombinant microorganism expressing the polypeptide capable of glycosylating steviol or a steviol glycoside at its C-13 hydroxyl group; the polypeptide capable of beta 1,3 glycosylation of the C3' of the 13-O- glucose, 19-O-glucose, or both 13-O-glucose and 19-O-glucose of a steviol glycoside; the polypeptide capable of glycosylating steviol or a steviol glycoside at its C-19 carboxyl group; and the polypeptide capable of beta 1,2 glycosylation of the C2' of the 13-O-glucose, 19-O-glucose, or both 13-O-glucose and 19-O-glucose of a steviol glycoside.

22. The method of claim 7, wherein Rebaudioside D is synthesized in the recombinant microorganism expressing the polypeptide capable of glycosylating steviol or the steviol glycoside at its C-13 hydroxyl group; the polypeptide capable of beta 1,3 glycosylation of the C3' of the 13-O-glucose, 19-O-glucose, or both 13-O-glucose and 19-O-glucose of a steviol glycoside; the polypeptide capable of glycosylating steviol or a steviol glycoside at its C-19 carboxyl group; and the polypeptide capable of beta 1,2 glycosylation of the C2' of the 13-O-glucose, 19-O-glucose, or both 13-O-glucose and 19-O-glucose of a steviol glycoside.

23. The method of claim 7, wherein Rebaudioside M is synthesized in the recombinant microorganism expressing the polypeptide capable of glycosylation of the 13-OH of steviol; the polypeptide capable of beta 1,3 glycosylation of the C3' of the 13-O-glucose, 19-O-glucose, or both 13-O-glucose and 19-O-glucose of a steviol glycoside; the polypeptide capable of glycosylating steviol or a steviol glycoside at its C-19 carboxyl group; and the polypeptide capable of beta 1,2 glycosylation of the C2' of the 13-O-glucose, 19-O-glucose, or both 13-O-glucose and 19-O-glucose of a steviol glycoside.

24. The method of claim 7, wherein culturing includes constitutively expressing one or more of the genes.

* * * * *